(12) United States Patent
Huang et al.

(10) Patent No.: US 12,144,310 B2
(45) Date of Patent: Nov. 19, 2024

(54) TOBACCO PLANT RESISTANT TO SPOTTED WILT DISEASE WITHOUT LINKAGE DRAG AND METHOD FOR BREEDING THE SAME

(71) Applicant: Yunnan Academy of Tobacco Agricultural Sciences, Yunnan (CN)

(72) Inventors: Changjun Huang, Yunnan (CN); Yong Liu, Yunnan (CN); Haiqin Yu, Yunnan (CN)

(73) Assignee: Yunnan Academy of Tobacco Agricultural Sciences, Yunnan (CN)

( * ) Notice: Subject to any disclaimer, the term of this patent is extended or adjusted under 35 U.S.C. 154(b) by 0 days.

(21) Appl. No.: 17/763,779

(22) PCT Filed: Nov. 8, 2021

(86) PCT No.: PCT/CN2021/129382
§ 371 (c)(1),
(2) Date: Mar. 25, 2022

(87) PCT Pub. No.: WO2022/262179
PCT Pub. Date: Dec. 22, 2022

(65) Prior Publication Data
US 2024/0049674 A1    Feb. 15, 2024

(51) Int. Cl.
*A01H 6/82* (2018.01)
*A01H 1/00* (2006.01)
*A01H 1/02* (2006.01)
*A01H 1/04* (2006.01)
*C12Q 1/6895* (2018.01)

(52) U.S. Cl.
CPC ............... *A01H 6/823* (2018.05); *A01H 1/02* (2013.01); *A01H 1/045* (2021.01); *A01H 1/126* (2021.01); *C12Q 1/6895* (2013.01); *C12Q 2600/13* (2013.01)

(58) Field of Classification Search
None
See application file for complete search history.

(56) References Cited

FOREIGN PATENT DOCUMENTS

| CN | 110499389 A | * 11/2019 | ........... C12Q 1/6895 |
| WO | WO-2018119541 A1 | * 7/2018 | ................ C02F 3/34 |

OTHER PUBLICATIONS

Moon et al. (Crop Science, 47:1887-1894, 2007).*
Laskowska et al. (Euphytica, 193:207-219, 2013).*

* cited by examiner

*Primary Examiner* — Vinod Kumar
(74) *Attorney, Agent, or Firm* — Harness, Dickey & Pierce, P.L.C.; Anthony G. Fussner

(57) ABSTRACT

The invention relates to the field of tobacco breeding, particularly to a tobacco plant resistant to TSWD without linkage drag and a method for breeding the same. Provided is a tobacco plant or germplasm resistant to TSWD, which comprises a short RTSW introgressed segment, wherein at least part or entire of the sequence set forth in SEQ ID No.34 is deleted in the short RTSW introgressed segment as compared to the RTSW introgressed segment of tobacco 'Polalta'. Also provided is a method for screening said tobacco plant or germplasm, in which a tobacco plant or germplasm resistant to TSWD carrying a short RTSW introgressed segment is obtained by detecting NaChr4_2M, NaChr4_8M, NaChr3_62.6M and NaChr3_64.6M linkage drag locus markers. Compared with 'Polalta', the tobacco plant or germplasm provided by the invention not only has TSWD resistance, but also reduces or removes linkage drag.

10 Claims, 5 Drawing Sheets
Specification includes a Sequence Listing.

TOBACCO PLANT RESISTANT TO SPOTTED WILT DISEASE WITHOUT LINKAGE DRAG AND METHOD FOR BREEDING THE SAME

This patent application is a U.S. national stage filing under 35 U.S.C. § 371 of International Application No. PCT/CN2021/129382 filed Nov. 8, 2021. The disclosure of the application identified in this paragraph is incorporated herein by reference in its entirety.

FIELD OF THE INVENTION

The invention relates to the field of tobacco breeding, particularly to molecular markers for screening tobacco plants resistant to spotted wilt disease without linkage drag, tobacco plants resistant to spotted wilt disease without linkage drag, and methods for breeding the same.

BACKGROUND OF THE INVENTION

Tobacco spotted wilt disease (TSWD) is a severe disease caused by Orthotospoviruses infection. TSWD causes dwarfing of tobacco plants, wrinkled leaves, and small necrotic rings densely distributing on leaves. These rings often merge into large spots to form irregular necrotic areas. The disease expands rapidly from the infection site to the top of the tobacco plant. Apical buds of the plant wilt and droop, eventually leading to necrosis of the entire plant and completely losing economic value. Orthotospoviruses belong to family Tospoviridae in the order Bunyavirales, and Tomato spotted wilt virus (TSWV) is the type member of this genus. Orthotospoviruses has become a huge threat to agricultural production due to its wide host range and devastating economic losses. It is recognized as one of the most destructive viruses in plant viruses and ranks second in the list of the most important plant viruses in the world. Resistant to orthotospoviruses breeding is the most economical and effective approach for TSWD prevention and control, which also fundamentally meets the needs of agricultural green prevention and control. However, there are currently no flue-cured tobacco cultivars resistant to TSWD in cultivated tobacco (*Nicotiana tabacum* L.). All commercial tobacco cultivars are susceptible to TSWV and have been a potential threat to the epidemic and outbreak of TSWD.

Previous studies have shown that wild relatives possess many excellent alleles which can be utilized for crop varietal improvement. Discovering and effectively utilizing these desirable alleles from wild relatives, such as disease resistance genes, is conducive to enhancing disease resistance of cultivars, and has become one of the most indispensible methods for improving resistance of crops. Previous studies have shown that *Nicotiana alata*, a wild tobacco belonging to the genus *Nicotiana*, has good resistance to TSWV and is the only available germplasm of resistance to TSWD so far. *N alata* inoculated with TSWV only showed symptoms of hypersensitive necrosis on the inoculated leaves, and the presence of the virus was not detected in the systemic leaves. Using *N otophora* as a bridge parent, Gajos et al. successfully transferred the TSWV resistance locus (referred as RTSW locus, where RTSW is the abbreviation of Resistance to TSWV) from wild tobacco *N alata* to cultivated tobacco (*N tabacum* L.), and produced the variety 'Polalta' carrying a long RTSW introgressed segment. Genetic analysis of segregation population combined with molecular markers showed that RTSW was a single dominant locus, and few dominant molecular markers for RTSW locus were developed (Moon H, Nicholson J S, 2007. AFLP and SCAR Markers Linked to Tomato Spotted Wilt Virus Resistance in Tobacco. Crop Sci. 47, 1887-94.).

However, many genes unfavorable to agronomic traits often exist in wild relatives at the same time. If undesirable genes are closely linked to the target gene to be transferred, it will lead to linkage drag and increase the difficulty of utilizing desirable genes. Unfortunately, TSWD resistant tobacco 'Polalta' and other cultivated tobaccos carrying a long RTSW introgressed segment (including cultivated tobacco lines and varieties) all show severe linkage drag, mainly hampered by growth retardation, thickened veins, irregular distortions of veins, thickened leaves and veins, narrow leaves and other leaf deformations, dwarfing (FIG. 1), and varying degrees of reduced fertility, such as decreased seed setting rate, shriveled fruit and decreased seed quantity in a single fruit. Genetic linkage analysis indicates that the linkage drag may be derived from the linkage drag genes tightly linked to or co-segregated with the RTSW locus on the long RTSW introgressed segment, but the subtle genetic linkage relationship is still obscure. Global tobacco industry urgently needs TSWD resistance tobacco cultivars, but due to the existence of linkage drag, even though the RTSW locus has been introgressed to cultivated tobacco (*N tabacum* L.) for more than 40 years, there are not tobacco cultivars with high resistance to TSWD for commercial cultivation.

SUMMARY OF THE INVENTION

In order to address the above problems, the present invention provides molecular markers for identifying or screening cultivated tobacco (*N tabacum* L.) plants (including cultivated tobacco lines and varieties) resistant to TSWD without linkage drag and a method for breeding tobacco plants resistant to TSWD without linkage drag. Finally, by using the molecular markers and the method mentioned above, we obtained linkage drag-free TSWD resistance tobacco plants in this invention.

The invention discloses two linkage drag loci that lead to developmental deformations of leaves and plants in cultivated tobacco (including cultivated tobacco lines and varieties) with resistance to TSWD, wherein the first linkage drag locus (DEF1) comes from the end of chromosome 4 of *N alata*, which can be detected with the marker NaChr4_2M set forth in SEQ ID No. 10 and/or the marker NaChr4_8M set forth in SEQ ID No. 11; the second linkage drag locus (DEF2) comes from chromosome 3 of *N alata*, which can be detected with the marker NaChr3_62.6M set forth in SEQ ID No. 7 and/or the marker NaChr3_64.6 M set forth in SEQ ID No. 8. In order to obtain linkage drag-free TSWD resistance tobacco plants (including cultivated tobacco lines and varieties), both DEF1 and DEF2 loci need to be segregated separately or simultaneously from a plant carrying the RTSW locus.

The invention provides a method for detecting the linkage drag loci, DEF1 and DEF2. Specifically, the molecular markers NaChr4_2M (amplification primers are NaChr4_2MF/NaChr4_2MR) and NaChr4_8M (amplification primers are NaChr4_8MF/NaChr4_8MR) developed in the invention can be used to detect the DEF1 locus in backcross or self-cross segregation population. If the results of both primer pairs are negative, or the performances of the polymorphic markers with a genetic distance from the two markers within about 20 cM, 10 cM, 5 cM, 4 cM, 3 cM, 2 cM, 1 cM, 0.5 cM or less than 0.5 cM in a plant are consistent with that in the recipient parent, it indicates that the DEF1 locus has been segregated from the plant. Further, the molecular markers NaChr3_62.6M (amplification primers are NaChr3_62.6MF/NaChr3_62.6MR) and NaChr3_64.6 M (amplification primers are NaChr3_64.6MF/NaChr3_64.6MR) can be used to detect the DEF2 locus. If the results of both primer pairs are negative, or the performances of the polymorphic markers with a genetic distance from the two markers within about 20 cM, 10 cM, 5 cM, 4 cM, 3 cM, 2 cM, 1 cM, 0.5 cM or less than 0.5 cM in a plant are consistent with that in the recipient parent, it indicates that the DEF2 locus has been segregated from the plant.

The invention discloses a DNA segment having a nucleotide sequence set forth in SEQ ID No. 34. The segment is located on chromosome 3 of *N alata* and comprises the DEF2 locus. The DNA segment set forth in SEQ ID No. 34 is a non-target genomic segment closed to the RTSW gene (TSWD resistance gene) on the long RTSW introgressed segment in the tobacco material 'Polalta', and is a determinant of linkage drag in RTSW cultivated tobacco. Removal of part or entire of the sequence set forth in SEQ ID No. 34 from the long RTSW introgressed segment may reduce linkage drag. It will be understood by those skilled in the art that when removing part or entire of the sequence set forth in SEQ ID No. 34 from the long RTSW introgressed segment, simultaneously removing the upstream and downstream sequences at the 5' end and/or 3' end of the sequence set forth in SEQ ID No. 34 can also achieve the effect of reducing linkage drag.

The invention provides a tobacco plant or germplasm resistant to TSWD, which comprises a short RTSW introgressed segment without part or entire of the sequence set forth in SEQ ID No. 34, compared to a long RTSW introgressed segment of tobacco 'Polalta'.

In some embodiments of the invention, the tobacco plant or germplasm does not comprise a first linkage drag locus marker and/or a second linkage drag locus marker, wherein the first linkage drag locus marker comprises marker NaChr4_2M set forth in SEQ ID No. 10 and/or marker NaChr4_8 M set forth in SEQ ID No. 11, and the second linkage drag locus marker comprises marker NaChr3_62.6 M set forth in SEQ ID No. 7 and/or marker NaChr3_64.6 M set forth in SEQ ID No. 8; in particular, the marker NaChr3_62.6 M is located at 1-633 bp of the sequence set forth in SEQ ID No. 34; the marker NaChr3_64.6 M is located at 2210450-2210943 bp of the sequence set forth in SEQ ID No. 34.

In some embodiments of the invention, the second linkage drag locus marker further comprises NaChr3_44.2 M marker set forth in SEQ ID No. 1, NaChr3_54M marker set forth in SEQ ID No. 2, NaChr3_57M marker set forth in SEQ ID No. 3 and/or NaChr3_58M marker set forth in SEQ ID No. 4.

In some embodiments of the invention, the tobacco plant or germplasm comprises a TSWD resistance marker that comprises NaChr3_59 M marker set forth in SEQ ID No. 5.

In some embodiments of the invention, the tobacco plant or germplasm comprises NaChr3_59 M marker set forth in SEQ ID No. 5, and does not comprise NaChr4_2M marker set forth in SEQ ID No. 10, NaChr4_8 M marker set forth in SEQ ID No. 11, and NaChr3_64.6 M marker set forth in SEQ ID No. 8.

In some embodiments of the invention, the tobacco plant or germplasm comprises NaChr3_59 M marker, and does not comprise NaChr4_2M, NaChr4_8 M, NaChr3_44.2 M, NaChr3_58M or NaChr3_64.6 M marker.

In some embodiments of the invention, the tobacco plant or germplasm comprises NaChr3_59 M and NaChr3_62.6 M markers, and does not comprise NaChr4_2M, NaChr4_8 M, NaChr344.2M, NaChr3_54M, NaChr3_57M, NaChr3_58M, NaChr3_64.6M markers.

In some embodiments of the invention, the short RTSW introgressed segment is obtained by means of chromosome recombination, genome editing, chemical mutagenesis, physical mutagenesis, or artificial de novo gene synthesis.

In some embodiments of the invention, the tobacco plant or germplasm is selected from Burley tobacco, Dark tobacco, Flue-cured tobacco, Maryland tobacco, Oriental tobacco or Cigar tobacco.

In some embodiments of the invention, a novel TSWD resistance cultivated tobacco (*N tabacum* L.) plant is provided. The tobacco plant is resistant to TSWD caused by orthotospoviruses infection, and without any visible linkage drag. The novel tobacco plant comprises the RTSW locus conferring resistance to TSWD, but does not comprise the DEF1 and DEF2 loci. Specifically, in this plant, as compared with the known 'Polalta', the introgression segment derived from chromosome 4 of *N alata* is segregated (shown as negative for the molecular markers NaChr4_2M and NaChr4_8 M), and the 43-65 Mb segment of chromosome 3 of *N alata* is shortened, in particular, a segment derived from chromosome 3 of *N alata* is segregated, in particular, the results of the molecular marker test showed that NaChr344.2M, NaChr3_54M, NaChr3_57M, NaChr3_58M, NaChr3_62.6M and NaChr3_64.6 M are negative in this novel TSWD resistance tobacco.

The invention further provides a method for producing hybrid plant seeds using the novel TSWD resistance tobacco (*N tabacum* L.) plant provided by the invention. In a representative embodiment, the method comprises: using the novel TSWD resistance tobacco plant provided by the invention as the male parent or the female parent to form hybrid seeds with any tobacco (*N tabacum* L.) variety and line, and identifying, screening and producing cultivated tobacco (*N tabacum* L.) plants resistant to TSWD by the method of the invention.

The invention also provides a method for screening a tobacco plant or germplasm resistant to TSWD with reduced linkage drag, the method comprising:
  (a) screening tobacco plants or germplasms resistant to TSWD and isolating their nucleic acids;
  (b) detecting a first linkage drag locus marker and/or a second linkage drag locus marker in the isolated nucleic acids; the first linkage drag locus marker comprises NaChr4_2M marker set forth in SEQ ID No. 10 and/or NaChr4_8M marker set forth in SEQ ID No. 11; the second linkage drag locus marker comprises NaChr3_62.6 M marker set forth in SEQ ID No. 7 and/or NaChr3_64.6 M marker set forth in SEQ ID No. 8;
  (c) selecting a tobacco plant or germplasm resistant to TSWD that does not comprise the first linkage drag locus marker and/or the second linkage drag locus marker.

In some embodiments of the invention, NaChr4_2MF/NaChr4_2MR primer pair and NaChr4_8MF/NaChr4_8MR primer pair developed by the invention can be used to detect the molecular markers NaChr4_2M and NaChr4_8M in a tobacco backcross or self-cross population carrying the RTSW locus to screen a tobacco plant or germplasm resistant to TSWD with reduced linkage drag; If the detection results of both primer pairs are negative, or the performances of the polymorphic markers with a genetic distance from the two markers within about 20 cM, 10 cM, 5 cM, 4 cM, 3 cM, 2 cM, 1 cM, 0.5 cM or less than 0.5 cM in a tobacco plant are consistent with that in the recipient parent, it indicates that the DEF1 locus has been segregated from the tobacco plant. Further, NaChr3_62.6MF/NaChr3_62.6MR primer pair and NaChr3_64.6MF/NaChr3_64.6MR primer pair developed by the invention can be used to detect the molecular markers NaChr3_62.6 M and NaChr3_64.6 M to screen a tobacco plant or germplasm resistant to TSWD with reduced linkage drag; If the detection results of both primer pairs are negative, or the performances of the polymorphic markers with a genetic distance from the two markers within about 20 cM, 10 cM, 5 cM, 4 cM, 3 cM, 2 cM, 1 cM, 0.5 cM or less than 0.5 cM in a tobacco plant are consistent with that in the recipient parent, it indicates that the DEF2 locus has been segregated from the tobacco plant.

In some embodiments of the invention, the method for screening a tobacco plant or germplasm resistant to TSWD comprises: isolating nucleic acids of a tobacco plant or germplasm; detecting a TSWD resistance marker in the isolated nucleic acids; the TSWD resistance marker comprises NaChr3_59M marker set forth in SEQ ID No. 5; selecting a tobacco plant or germplasm comprising the TSWD resistance marker.

In some embodiments of the invention, the tobacco plant or germplasm resistant to TSWD is obtained by hybrid breeding methods, mutation breeding methods, genome editing breeding methods, and/or transgenic breeding methods.

In some embodiments of the invention, the second linkage drag locus marker further comprises NaChr3_44.2 M marker set forth in SEQ ID No. 1, NaChr3_54M marker set forth in SEQ ID No. 2, NaChr3_57M marker set forth in SEQ ID No. 3, and/or NaChr3_58M marker set forth in SEQ ID No. 4.

In some embodiments of the invention, the detection includes polymerase chain reaction or nucleic acid sequencing.

In some embodiments of the invention, the method for screening a tobacco plant or germplasm resistant to TSWD with reduced linkage drag comprises:
(a) crossing a RTSW locus-containing tobacco plant with a tobacco plant having rtsw/rtsw genotype to obtain a F1 tobacco plant having RTSW/rtsw genotype, and then backcrossing the F1 tobacco plant with a tobacco plant having rtsw/rtsw genotype to obtain a population material BC1F1 for screening a tobacco plant or germplasm resistant to TSWD with reduced linkage drag;
(b) isolating nucleic acids from BC1F1 tobacco plants, and using NaChr3_44.2 M primer pair, NaChr3_54M primer pair, NaChr3_57M primer pair, NaChr3_58M primer pair and NaChr3_59M primer pair respectively for PCR detection; screening tobacco plants detected as positive for NaChr3_59M primer pair, and negative for all of NaChr3_44.2 M primer pair, NaChr3_54M primer pair, NaChr3_57M primer pair and NaChr3_58M primer pair;
(c) testing TSWD resistance of the tobacco plants obtained in step (b);
(d) backcrossing the tobacco plants detected as positive for TSWD resistance in step (c) with a tobacco plant having rtsw/rtsw genotype to obtain a population material BC2F1; (e) observing the phenotype of the population material BC2F1 at the seedling stage, and pulling out plants with deformed development; among them, deformations in the seedling stage are mainly manifested as leaf deformations, including thickened veins, irregular distortions of veins, thickened leaves and veins, and narrow leaves; (0 testing the resistance of the plants with normal phenotype obtained in step (e) to TSWD, or extracting genomic DNA of the plants and then using NaChr3_59M primer pair for PCR detection, and screening a tobacco plant detected as positive for TSWD resistance test or positive for NaChr3_59M primer pair;
(g) isolating nucleic acids from the tobacco plants obtained in step (f), using NaChr4_2M primer pair, NaChr4_8 M primer pair, NaChr3_59M primer pair and NaChr3_64.6 M primer pair for genotyping; selecting a tobacco plant detected as positive for NaChr3_59M primer pair and negative for all of NaChr4_2M primer pair, NaChr4_8 M primer pair and NaChr3_64.6 M primer pair.

The population includes a population of BC1F1, BC2F1, BC3F1, BC4F1, BC5F1, BC5F2, BC5F3, BC6F1, BC6F2 . . . BCmFn obtained by crossing, backcrossing and self-crossing, where 'm' represents the number of generations of backcrossing, and 'n' represents the number of generations of self-crossing after backcrossing.

The invention also provides a method for breeding a tobacco plant or germplasm resistant to TSWD with reduced linkage drag, the method comprising:
(a) crossing a first tobacco plant or germplasm thereof with a second tobacco plant or germplasm thereof to produce a progeny tobacco plant or germplasm thereof, wherein the first tobacco plant or germplasm thereof comprises a TSWD resistance marker and does not comprise a first linkage drag locus marker and/or a second linkage drag locus marker; the TSWD resistance marker comprises NaChr3_59M marker set forth in SEQ ID No. 5; the first linkage drag locus marker comprises NaChr4_2M marker set forth in SEQ ID No. 10 and/or NaChr4_8 M marker set forth in SEQ ID No. 11; the second linkage drag locus marker comprises NaChr3_62.6M marker set forth in SEQ ID No. 7 and/or NaChr3_64.6 M marker set forth in SEQ ID No. 8;
(b) isolating nucleic acids from the progeny tobacco plant or germplasm thereof; (c) testing the TSWD resistance marker, the first linkage drag locus marker, and the second linkage drag locus marker in the isolated nucleic acids, thereby producing a progeny tobacco plant or germplasm that comprises the TSWD resistance marker and does not comprise the first linkage drag locus marker and/or the second linkage drag locus marker.

In some embodiments of the invention, the first tobacco plant or germplasm thereof is obtained by hybrid breeding methods, mutation breeding methods, genome editing breeding methods and/or transgenic breeding methods.

In some embodiments of the invention, the second linkage drag locus marker further comprises NaChr344.2M marker set forth in SEQ ID No. 1, NaChr3_54M marker set forth in SEQ ID No. 2, NaChr3_57M marker set forth in SEQ ID No. 3, and/or NaChr3_58M marker set forth in SEQ ID No. 4.

In some embodiments of the invention, the detection includes polymerase chain reaction or nucleic acid sequencing.

In some embodiments of the invention, the first tobacco plant or germplasm thereof and the second tobacco plant or germplasm thereof are selected from Burley tobacco, Dark tobacco, Flue-cured tobacco, Maryland tobacco, Oriental tobacco or Cigar tobacco.

The invention also provides a kit, comprising a primer set configured to detect a TSWD resistance marker, a first linkage drag locus marker, and a second linkage drag locus marker; the TSWD resistance marker comprises NaChr3_59M marker set forth in SEQ ID No. 5; the first linkage drag locus marker comprises NaChr4_2 M marker set forth in SEQ ID No. 10 and/or NaChr4_8 M marker set forth in SEQ ID No. 11; the second linkage drag locus marker comprises NaChr3_62.6 M marker set forth in SEQ ID No. 7 and/or NaChr3_64.6 M marker set forth in SEQ ID No. 8.

In some embodiments of the invention, the second linkage drag locus marker further comprises NaChr3_44.2 M marker set forth in SEQ ID No. 1, NaChr3_54M marker set forth in SEQ ID No. 2, NaChr3_57M marker set forth in SEQ ID No. 3, and/or NaChr3_58M marker set forth in SEQ ID No. 4.

In some embodiments of the invention, amplification primers of the NaChr3_59M marker are set forth in SEQ ID No. 20 and SEQ ID No. 21; amplification primers of the NaChr4_2 M marker are set forth in SEQ ID No. 30 and SEQ ID No. 31; amplification primers of the NaChr4_8 M marker are set forth in SEQ ID No. 32 and SEQ ID No. 33; amplification primers of the NaChr3_62.6 M marker are set forth in SEQ ID No. 24 and SEQ ID No. 25; amplification primers of the NaChr3_64.6 M marker are set forth in SEQ ID No. 26 and SEQ ID No. 27; amplification primers of the NaChr3_44.2 M marker are set forth in SEQ ID No. 12 and SEQ ID No. 13; amplification primers of the NaChr3_54M marker are set forth in SEQ ID No. 14 and SEQ ID No. 15; amplification primers of the NaChr3_57M marker are set forth in SEQ ID No. 16 and SEQ ID No. 17; amplification primers of the NaChr3_58M marker are set forth in SEQ ID No. 18 and SEQ ID No. 19.

The invention also provides a molecular marker set for screening a tobacco plant or germplasm resistant to TSWD with reduced linkage drag, which comprises a first linkage drag locus marker and/or a second linkage drag locus marker; the first linkage drag locus marker comprises NaChr4_2 M marker set forth in SEQ ID No. 10 and/or NaChr4_8 M marker set forth in SEQ ID No. 11; the second linkage drag locus marker comprises NaChr3_62.6 M marker set forth in SEQ ID No. 7 and/or NaChr3_64.6 M marker set forth in SEQ ID No. 8.

In some embodiments of the invention, the molecular marker set further comprises a TSWD resistance marker, the nucleotide sequence of which is set forth in SEQ ID No. 5.

The invention also provides a primer set for screening a tobacco plant or germplasm resistant to TSWD with reduced linkage drag, comprising: the primers set forth in SEQ ID No. 30 and SEQ ID No. 31 for amplifying NaChr4_2 M marker; the primers set forth in SEQ ID No. 32 and SEQ ID No. 33 for amplifying NaChr4_8 M marker; the primers set forth in SEQ ID No. 24 and SEQ ID No. 25 for amplifying NaChr3_62.6 M marker; the primers set forth in SEQ ID No. 26 and SEQ ID No. 27 for amplifying NaChr3_64.6 M marker; the primers set forth in SEQ ID No. 12 and SEQ ID No. 13 for amplifying NaChr344.2M marker; the primers set forth in SEQ ID No. 14 and SEQ ID No. 15 for amplifying NaChr3_54M marker; the primers set forth in SEQ ID No. 16 and SEQ ID No. 17 for amplifying NaChr3_57M marker; the primers set forth in SEQ ID No. 18 and SEQ ID No. 19 for amplifying NaChr3_58M marker.

In some embodiments of the invention, the primer set further comprises the primers set forth in SEQ ID No. 20 and SEQ ID No. 21 for amplifying NaChr3_59 M marker.

The invention also provides a method for screening a tobacco plant or germplasm resistant to TSWD, the method comprising: (a) isolating nucleic acids from a tobacco plant or germplasm; (b) testing at least one TSWD resistance marker in isolated nucleic acids; the TSWD resistance marker comprises NaChr3_59 M marker set forth in SEQ ID No. 5; (c) selecting a tobacco plant or germplasm comprising at least one TSWD resistance marker.

In some embodiments of the invention, the method comprises: (a) isolating nucleic acids from a tobacco line or variety to be tested; (b) detecting one or more markers tightly linked to the RTSW locus in isolated nucleic acids; and (c) based on the detection result of markers, selecting a tobacco plant with resistance to TSWD. Preferably, detecting NaChr3_59 M marker tightly linked to the RTSW locus in isolated nucleic acids; if the amplified product of NaChr3_59MF/NaChr3_59MR primer pair is positive, or the performances of the polymorphic markers with a genetic distance from the primer pair within about 20 cM, 10 cM, 5 cM, 4 cM, 3 cM, 2 cM, 1 cM, 0.5 cM or less than 0.5 cM in the tobacco line or variety are consistent with that in the donor parent 'Polalta', then it is a tobacco plant with resistance traits to TSWD.

In some embodiments of the invention, the detection includes polymerase chain reaction or nucleic acid sequencing.

In some embodiments of the invention, amplification primers of the NaChr3_59 M marker are set forth in SEQ ID No. 20 and SEQ ID No. 21.

The invention also provides a molecular marker for screening a tobacco plant or germplasm resistant to TSWD, the nucleotide sequence of which is set forth in SEQ ID No. 5.

The invention also provides molecular marker primers for screening a tobacco plant or germplasm resistant to TSWD, the nucleotide sequences of which are set forth in SEQ ID No. 20 and SEQ ID No. 21.

The invention also provides a method for introducing TSWD resistance into a tobacco variety, the method comprising: (a) crossing a tobacco donor parent (such as 'Polalta') having TSWD resistance with a tobacco recipient parent that does not have TSWD resistance to produce one or more progeny tobacco plants; (b) genotyping the one or more progeny tobacco plants, and detecting a polymorphic marker NaChr3_59 M linked to TSWD resistance; if the amplified product of NaChr3_59MF/NaChr3_59MR primer is positive, or the performances of the polymorphic markers with a genetic distance from the NaChr3_59M marker within about 20 cM, 10 cM, 5 cM, 4 cM, 3 cM, 2 cM, 1 cM, 0.5 cM or less than 0.5 cM in the progeny tobacco plant are consistent with that in the donor parent 'Polalta', then the progeny tobacco plant has resistance to TSWD; and (c) selecting progeny tobacco plants having resistance to TSWD. Preferably, the method further comprises backcrossing a selected progeny tobacco plant with a tobacco recurrent parent. The method further comprises: (d) crossing the selected progeny plant with itself or with the tobacco recurrent parent to produce one or more further progeny tobacco plants; and (e) selecting further progeny tobacco plants having resistance to TSWD. Preferably, the selection step (e) includes marker-assisted selection. Generally, the tobacco recipient parent is an elite cultivar. Generally, the genotyping step of these methods involves a determination of one or more molecular markers. Generally, the polymorphic markers used in the method include polymorphisms selected from the group consisting of single nucleotide polymorphisms (SNPs), insertions or deletions in DNA sequences (Indels), simple sequence repetitions of DNA sequences (SSR), restriction fragment length polymorphism (RFLP) and marker SNP.

The invention also provides tobacco plants and/or germplasms identified, produced or selected by the method of the invention, and any progeny or seeds derived from the tobacco plants or germplasms identified, produced or selected by the method.

Those skilled in the art should understand that the methods for obtaining TSWD resistant tobacco plants with reduced linkage drag, TSWD resistant tobacco plants with DEF1 and/or DEF2 loci segregated, and tobacco plants carrying a short RTSW introgressed segment include but are not limited to: hybrid breeding methods, chemical mutagenesis methods or physical mutagenesis methods, genome editing methods in biotechnology, and artificial de novo gene synthesis methods. Chemical mutagenesis methods include treatment with mutagens such as sodium azide, ethidium bromide, and ethyl methanesulfonate. Physical mutagenesis methods include treatment with X-rays, gamma rays, fast neutron radiation, heavy ion radiation and ultraviolet radiation. Genome editing methods in biotechnology include gene editing technologies such as CRISPR/Cas9 technology, zinc finger endonuclease (ZFN) technology, and transcription activator-like effector nuclease (TALEN). The method of removing DEF1 and/or DEF2 loci from the RTSW introgressed segment, or mutating DEF1 and/or DEF2 loci on the RTSW introgressed segment to make it lose its function also belongs to the protection scope of the invention.

Those skilled in the art should understand that the tobacco plants used in the method described herein can be Burley tobacco, Dark tobacco, Flue-cured tobacco, Maryland tobacco, Oriental tobacco or Cigar tobacco. The tobacco plants used in the method described herein are generally derived from common tobacco, and can be derived from multiple common tobacco varieties. The varieties include but are not limited to K326, Yunyan 87, Yunyan 97, Yunyan 85, Yunyan 116, Yunyan 121, NC 89, Zhongy an 100, Honghuadajinyuan, Cuibi No. 1, BU 64, CC 101, CC 200, CC 13, CC 27, CC 33, CC 35, CC 37, CC65, CC 67, CC 301, CC 400, CC 500, CC 600, CC 700, CC 800, CC 900, CC 1063, Coker 176, Coker 319, Coker 371Gold, Coker 48, CU 263, DF911, *Galpao* tobacco, GL 26H, GL 338, GL350, GL 395, GL 600, GL 737, GL 939, GL 973, GF 157, GF 318, RJR 901, HB 04P, K 149, K326, K 346, K 358, K394, K 399, K 730, NC 196, NC 37NF, NC 471, NC 55, NC 92, NC2326, NC95, NC 925, PVH 1118, PVH 1452, PVH 2110, PVH 2254, PVH 2275, VA116, VA119, KDH 959, KT200, KT204LC, KY 10, KY 14, KY 160, KY 17, KY 171, KY 907, KY907LC, KTY14×L8 LC, Little Crittenden, McNair 373, McNair 944, MsKY 14×L8, Narrow Leaf Madole, NC 100, NC 102, NC 2000, NC 291, NC 297, NC 299, NC 3, NC 4, NC 5, NC 6, NC7, NC 606, NC 71, NC72, NC 810, NC BH 129, NC 2002, Neal Smith Madole, OXFORD 207, ‘Perique’ tobacco, PVH03, PVH09, PVH19, PVH50, PVH51, R 610, R 630, R 7-11, R 7-12, RG 17, RG 81, RG H51, RGH 4, RGH 51, RS 1410, Speight 168, Speight 172, Speight 179, Speight 210, Speight 220, Speight 225, Speight 227, Speight 234, Speight G-28, Speight G-70, Speight H-6, Speight H20, Speight NF3, TI 1406, TI 1269, TN 86, TN86LC, TN 90, TN9OLC, TN 97, TN97LC, TN D94, TN D950, TR (Tom Rosson) Madole, VA 309, or VA359.

It is well known to those skilled in the art that in the primer sequence shown herein, 1-30 bases or any chemical modification can be added to the 5' end or 3' end respectively, wherein the added base type and chemical modification can be determined according to the base type of the matched region on the tobacco genomic DNA and the base pairing principle. The amplified product of the resulting primer pair is basically the same as that of the primer sequence shown herein (the DNA sequence between the forward primer and the reverse primer is the same). Therefore, the primer pairs obtained by adding 1-30 bases or any chemical modification at the 5' end or 3' end of the primer sequence shown herein and capable of amplifying substantially the same DNA segment are all included in the primer pairs of the invention. In a specific embodiment of the present invention, the primer pairs of the present invention are preferably the sequences set forth in SEQ ID No. 12-33.

Those skilled in the art should understand that examples of screening and selecting methods include, but are not limited to, Southern analysis, PCR amplification for detecting polynucleotides, Northern blotting, RNase protection, primer extension, RT-PCR amplification for detecting RNA transcripts, enzyme assays for detecting ribozyme activity of enzymes or polypeptides and polynucleotides, as well as protein gel electrophoresis, western blotting, immunoprecipitation, and enzyme-linked immunoassays for detecting polypeptides. Other techniques such as in situ hybridization, enzyme staining, and immunostaining can also be used to detect the presence or expression of polynucleotides. Methods of implementing all cited technologies are known.

Definition

Unless otherwise defined, all technical and scientific terms used herein have the same meaning as commonly understood by those of ordinary skill in the art to which the subject matter of this disclosure belongs. Although it is considered that the following terms can be well understood by those of ordinary skill in the art, the following definitions are proposed to make the subject of the present disclosure easy to understand.

The term “RTSW gene” refers to a gene in the genome of *N alata* that confers *N alata* resistance to TSWD.

The term “RTSW locus”, “RTSW resistance locus”, “TSWV resistance locus”, “TSWD resistance locus” or “TSWD resistance gene locus” refers to a DNA segment in the genome of *N alata* that contains the RTSW gene. This locus, in either heterozygous or homozygous state, confers tobacco plants resistance to TSWD.

The term “RTSW introgressed segment” or “resistance introgressed segment” refers to a DNA segment of *N alata* containing the RTSW gene. Generally, containing “RTSW introgressed segment” or “resistance introgressed segment” confers tobacco plants resistance to TSWD.

The term “short RTSW introgressed segment” or “short resistance introgressed segment” refers to a DNA segment that lacks part or all of non-target gene components (linkage drag gene components) linked to the RTSW gene on the long RTSW introgressed segment, and retains complete RTSW gene function.

The term “introgression” or “introgress” refers to the transfer of a desired allele of a genetic locus from one genetic background to another genetic background.

The term “linkage drag” refers to the linkage or co-segregation between favorable genes (target genes) and unfavorable genes (non-target genes) in a breeding process, so that when favorable genes are introgressed, unfavorable genes are also introgressed, often resulting in a new variety with undesirable traits. This kind of linkage drag is more common in the process of distant hybridization and backcross. The linkage drag of cultivated tobacco (*N tabacum* L.)

plants (including cultivated tobacco lines and varieties) resistant to TSWD herein is specifically manifested as varying degrees of developmental delay, dwarfing of plants, and leaf deformations including thickened veins, irregular distortions of veins, thickened leaves and veins, narrow leaves, etc., and varying degrees of reduced fertility, such as decreased seed setting rate, shriveled fruit and decreased seed quantity of a single fruit.

The term "linkage drag gene component" refers to a genomic component that contains a drag gene (non-target gene) but does not contain the RTSW gene (target gene) on a long RTSW introgressed segment. The "linkage drag gene component" can contain one or more "linkage drag loci". In a cultivated tobacco (N tabacum L.) plant resistant to TSWD, the "linkage drag gene component" is derived from the genome of N alata, specifically a segment derived from chromosome 4 of N alata, which can be detected with NaChr4_2M and NaChr4_8M molecular markers; and a shortened segment derived from chromosome 3 of N alata, which can be detected with NaChr344.2M, NaChr3_54M, NaChr3_57M, NaChr3_58M, NaChr3_62.6M and NaChr3_64.6M molecular markers.

The term "linked marker" refers to when a marker is linked to a trait and when the presence of the marker indicates whether and/or to what extent the desired trait or trait form will occur in the plant/germplasm comprising the marker, then the marker is "linked" to the trait. Similarly, when a marker is linked to an allele and when the presence of the marker indicates whether the allele is present in the plant/germplasm comprising the marker, then the marker is "linked" to the allele. For example, "a marker linked to TSWD resistance" refers to a marker whose presence or absence can be used to predict whether and/or to what extent a tobacco plant shows a TSWD resistance phenotype (for example, a marker linked to tobacco TSWD resistance, e.g. any molecular marker described in Tables 3, 5, and 7).

The term "TSWD resistance marker" refers to a DNA segment tightly linked to the RTSW gene (target gene) on the RTSW introgressed segment.

The term "linkage drag locus marker" refers to a DNA segment tightly linked to a drag gene (non-target gene) on the RTSW introgressed segment.

The term "trait" refers to one or more detectable characteristics of a cell or organism that can be affected by genotype. A phenotype can be observed with naked eyes, or by any other evaluation means known in the art, such as microscopy, biochemical analysis, genetic analysis, determination of tolerance to specific diseases, and the like. In some cases, a phenotype is directly controlled by a single gene or genetic locus, such as a "single gene trait". In other cases, a phenotype is a result of several genes.

The term "locus" is a region of a chromosome where a polymorphic nucleic acid, trait determinant, gene or marker is located. The locus contains one or more polymorphisms in the population; for example, there are alternative alleles in some individuals. The term "allele" refers to an alternative nucleic acid sequence at a specific locus. The length of the allele can be as small as one nucleotide base, but is usually larger. For example, the first allele appears on one chromosome, while the second allele appears on a second homologous chromosome. For example, alleles appear on different chromosomes of a heterozygous individual, or appear among different homozygous or heterozygous individuals in a population.

The term "chromosomal interval" refers to the continuous linear span of genomic DNA located on a single chromosome. The chromosomal region where the "locus" is located in this disclosure can also be replaced by "chromosomal interval". The term "chromosome" herein is also denoted as "Chr".

The term "centimole (cM)" is a unit of measurement of recombination frequency. One cM equals 1% probability that a locus will be separated from a target locus. The Kosambi function (Kosambi, The estimation of map distances from recombination values. Annals of Eugenics, 12:172-75 (1944)) can be used to calculate the genetic distance involved in this disclosure from the recombination value. As used herein, "tightly linked to" or "associated with" means that a marker or locus is within a genetic distance of about 20 cM, 10 cM, 5 cM, 1 cM, 0.5 cM or less than 0.5 cM from another marker or locus. For example, 20 cM means that the frequency of recombination between a marker and a locus is equal to or less than about 20%.

The term "genotype" refers to genetic composition of an individual (or individual group) at one or more genetic loci that are associated with observable and/or detectable and/or exhibited traits (phenotype). The genotype is defined by one or more alleles of one or more known loci that an individual has inherited from its parents. "Genotype" can be used to refer to genetic composition at a single locus or multiple loci, or more generally, the term "genotype" can be used to refer to individual genetic composition of all genes in its genome. It is possible, for example, to indirectly characterize a genotype using markers and/or directly characterize a genotype by nucleic acid sequencing.

The terms "backcross" and "backcrossed" refer to a method by which progeny plants are repeatedly backcrossed to one of their parents. In a backcross scheme, a "donor" parent refers to a parent plant that has a desired allele or locus to be introgressed. A "recipient" parent (used one or more times) or "recurrent" parent (used two or more times) refers to a parent plant into which a gene or locus is introgressed. An initial cross produces F1 generation. The term "BC1" refers to the second-use of a "recipient (recurrent)" parent, "BC2" refers to the third-use of a "recipient (recurrent)" parent, and so on. Specifically, in the present invention, the elite parent 'K326' is a "recipient (recurrent)" parent, and the breeding material 'Polalta' is a "donor" parent.

The results of using the tobacco plant breeding procedures described herein include the disclosed lines, cultivars, varieties, progenies, backcross lines, and hybrids. The terms "cultivar" and "variety" refer to a group of similar plants that can be distinguished from other varieties within the same species by structural or genetic characteristics and/or performance. Varieties are usually, although not always, sold commercially. Despite having one or more distinguishing traits, a further characteristic of a variety is that the overall differences between individuals within the variety are very small. It can be self-pollinated and selected for several generations, or asexually propagated from a single parent by tissue or cell culture techniques to produce "pure line" varieties. A variety can be essentially derived from another line or variety. According to the definition of International Convention for Protection of New Plant Varieties (established on 2 Dec. 1961, revised at Geneva on 10 Nov. 1972, 23 Oct. 1978, and 19 Mar. 1991), a variety "basically derived" from an initial variety, if: a) it is mainly derived from the initial variety, or from a variety mainly derived from the initial variety, while retaining the expression of the necessary characteristics resulting from the genotype or genotype combination of the initial variety; b) it is obviously different from the initial variety; c) except for the difference caused by the derivation behavior, it is consistent with the initial variety in the expression of the necessary characteristics resulting from the genotype or genotype combination of the initial variety. For example, a substantially derived variety can be obtained by selecting natural or induced mutants, somatic asexual mutations, mutated individuals derived from plants of the initial variety, backcrossing or transformation. Unlike varieties, "line" most often refers to a group of plants used for non-commercial use, such as for plant research. A line usually shows very small overall differences in one or more target traits between individuals, although there may be some differences in other traits between individuals.

The term "selecting" or "selection" refers to the behavior of choosing or picking desired individuals from a population based on certain predetermined criteria in the context of marker-assisted selection or breeding.

The term "elite line" or "elite variety" is a line with agronomic advantages, which is produced from a number of cycles of breeding for a certain superior agronomic performance. Numerous elite lines are available and are known to those of ordinary skill in tobacco breeding field. Similarly, "elite germplasm" or elite variety of germplasm is a germplasm with agronomic advantages. Specifically, it has advantages in many agronomic aspects such as germination rate, emergence rate, seed vigor, herbicide resistance, insect resistance, disease resistance; high yield; high grade index value; maturation property; maturation quality; mechanical harvest performance; maturity tolerance; leaf quality; height, plant maturity (e.g. early maturing, early maturing to middle maturing, middle maturing, middle-late maturing or late maturing); stem size (e.g. small, medium, or large stems); or the number of leaves per plant (e.g. few (e.g. 5-10), medium (e.g. 11-15), or many (e.g. 16-21) leaves) or any combination thereof.

The term "cell necrosis hypersensitive reaction" or "hypersensitive reaction" or "HR" is a typical disease resistance response of rapid cell necrosis that occurs after plant-pathogen incompatibility interaction, and is a disease resistance mechanism of plants, accompanied by programmed cell death. It is characterized by the burst of cellular reactive oxygen species, rapid response of related disease resistance marker genes, and local cell death.

The term "avirulence gene" or "avirulence gene NSm" means that according to the gene-to-gene hypothesis, for any host disease resistance gene, the pathogenic species has a corresponding avirulence gene. Only when a pathogen carrying an avirulence gene infects a host plant carrying a corresponding resistance gene, the plant will be induced to develop resistance, otherwise the plant will be infected and become diseased. In the invention, the avirulence gene NSm is specially prepared from TSWV-derived NSm protein, which can cause cell necrosis hypersensitive reaction (HR) in host plants carrying the resistance gene RTSW.

Avirulence gene-induced HR method can be used to detect TSWD resistance of tobacco. The method is disclosed in Chinese patent no. ZL201710414755.X that is titled "a method for identifying tobacco resistance using the tomato spotted wilt virus NSm gene", comprising steps of: (a) infiltrating a suspension of *Agrobacterium* carrying the avirulence gene NSm into the leave between veins of a tobacco test host, specifically comprising: culturing *Agrobacterium* carrying the avirulence gene NSm in *Agrobacterium tumefaciens* medium LB at 28° C. for 24 hours, collecting bacterial cells by centrifugation, and then diluting the bacterial cells with infiltration buffer to obtain a bacterial suspension with an OD600 of 0.5; using a sterile syringe with the needle removed to inject 9.5-10.5 microliters of the bacterial suspension from the leaf back of a tobacco plant into the leaf between veins to form a visible infiltration spot; placing the inoculated tobacco plant in an environment of 20-28° C. and 80% humidity, alternately providing continuous illumination for 16 hours and continuous darkness for 8 hours, and observing a total of 72 hours. (b) detecting the hypersensitive reaction of the test host, specifically comprising: using EHA105 strain carrying pK2-35S-NSm+ p2300-35S-Sw-5b as a positive control and EHA105 strain carrying pK2-35S-NSs as a negative control to perform the test on the tobacco host; observeing: if the tobacco test host shows hypersensitive reaction induced by the identified strain carrying the avirulence gene NSm expression vector, then the tested tobacco is identified as a tobacco plant with resistance to TSWD.

DESCRIPTION OF THE FIGURES

FIG. 1A shows the phenotype of leaf deformations, including thickened veins, irregular distortions of veins, thickened leaves and veins, and narrow leaves; FIGS. 1B and 1C show the deformed phenotypes of the whole plant, which are characterized by growth retardation, distortions of stems, and dwarfing of plants.

DESCRIPTION OF THE SEQUENCE LISTING

Figure 1:
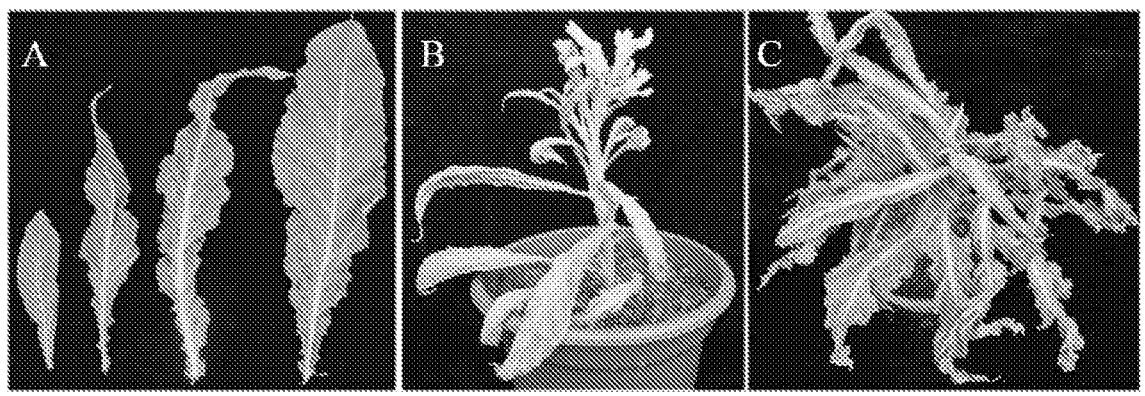
FIG. 1 shows the phenotype of linkage drag of tobacco plants carrying TSWD resistance locus. Tobacco plants were obtained by crossing the tobacco variety 'Polalta' as the donor parent and the susceptible elite cultivar '1(326' (*N tabacum* cv. K326) as the recipient parent, and backcrossing for 5 generations using '1(326' as the recurrent parent.

SEQ ID No. 1 is the nucleotide sequence of NaChr344.2M marker.
SEQ ID No. 2 is the nucleotide sequence of NaChr3_54 M marker.
SEQ ID No. 3 is the nucleotide sequence of NaChr3_57 M marker.
SEQ ID No. 4 is the nucleotide sequence of NaChr3_58 M marker.
SEQ ID No. 5 is the nucleotide sequence of NaChr3_59 M marker.
SEQ ID No. 6 is the nucleotide sequence of NaChr3_60 M marker.
SEQ ID No. 7 is the nucleotide sequence of NaChr3_62.6 M marker.
SEQ ID No. 8 is the nucleotide sequence of NaChr3_64.6 M marker.
SEQ ID No. 9 is the nucleotide sequence of NaChr3_65.7 M marker.
SEQ ID No. 10 is the nucleotide sequence of NaChr4_2M marker.
SEQ ID No. 11 is the nucleotide sequence of NaChr4_8M marker.
SEQ ID No. 12 is the forward primer used to amplify the NaChr344.2M marker.
SEQ ID No. 13 is the reverse primer used to amplify the NaChr344.2M marker.
SEQ ID No. 14 is the forward primer used to amplify the NaChr3_54 M marker.
SEQ ID No. 15 is the reverse primer used to amplify the NaChr3_54 M marker.
SEQ ID No. 16 is the forward primer used to amplify the NaChr3_57 M marker.
SEQ ID No. 17 is the reverse primer used to amplify the NaChr3_57 M marker.
SEQ ID No. 18 is the forward primer used to amplify the NaChr3_58 M marker.
SEQ ID No. 19 is the reverse primer used to amplify the NaChr3_58 M marker.
SEQ ID No. 20 is the forward primer used to amplify the NaChr3_59 M marker.
SEQ ID No. 21 is the reverse primer used to amplify the NaChr3_59 M marker.
SEQ ID No. 22 is the forward primer used to amplify the NaChr3_60 M marker.
SEQ ID No. 23 is the reverse primer used to amplify the NaChr3_60 M marker.
SEQ ID No. 24 is the forward primer used to amplify the NaChr3_62.6 M marker.
SEQ ID No. 25 is the reverse primer used to amplify the NaChr3_62.6 M marker.
SEQ ID No. 26 is the forward primer used to amplify the NaChr3_64.6 M marker.
SEQ ID No. 27 is the reverse primer used to amplify the NaChr3_64.6 M marker.
SEQ ID No. 28 is the forward primer used to amplify the NaChr3_65.7 M marker.
SEQ ID No. 29 is the reverse primer used to amplify the NaChr3_65.7 M marker.
SEQ ID No. 30 is the forward primer used to amplify the NaChr4_2M marker.
SEQ ID No. 31 is the reverse primer used to amplify the NaChr4_2M marker.
SEQ ID No. 32 is the forward primer used to amplify the NaChr4_8 M marker.
SEQ ID No. 33 is the reverse primer used to amplify the NaChr4_8 M marker.
SEQ ID No. 34 is a DNA sequence on the RTSW introgressed segment of 'Polalta' containing the second linkage drag locus (DEF2) but not the RTSW gene.

DETAILED DESCRIPTION OF THE INVENTION

The invention will be further described in detail below by examples. Those skilled in the art will understand that the following examples are only used to illustrate the invention and should not be regarded as limiting the scope of the invention. For those examples in which specific technologies or conditions are not indicated, it shall be carried out in accordance with the technologies or conditions described in the literature in the art or in accordance with the product specification. The reagents or instruments used without an indication of the manufacturer are all conventional products that can be obtained through purchase.

Tobacco material 'Polalta' is a TSWV resistant tobacco material carrying the RTSW locus (TSWD resistance locus), which has been published in a non-patent literature (Laskowska D, Berbeć A, 2010. TSWV resistance in DH lines of tobacco (N tabacum L.) obtained from a hybrid between 'Polalta' and 'Wiślica'. Plant Breeding 129, 731-3.). Tobacco variety '1(326' (N tabacum cv. K326) is a TSWV-susceptible tobacco material that does not possess the RTSW locus (TSWD resistance locus), which has been published in a non-patent literature (Edwards et al., 2017, A reference genome for Nicotiana tabacum enables map-based cloning of homologous loci implicated in nitrogen utilization efficiency. BMC Genomics 18, 448.), and the public can obtain its reference genome sequence from the website of solgenomics.net/organism/Nicotiana tabacum/genome. BC5F3, BC6F1 and BC6F2 progeny populations obtained by crossing of 'Polalta' and '1(326', backcrossing and self-crossing were created and preserved by our research group. N alata is a kind of wild tobacco resistant to TSWV, which has been published in a non-patent literature (Laskowska et al., 2013, A survey of Nicotiana germplasm for resistance to Tomato spotted wilt virus (TSWV). Euphytica 193, 207-19.). N alata used in the invention has an accession number of PI42334 in the tobacco germplasm bank of the United States. The above tobacco materials are common tobacco germplasm resources, and the public can obtain them from tobacco germplasm resources preservation organizations or Yunnan Academy of Tobacco Agricultural Sciences.

TSWV and *Agrobacterium* EHA105 carrying the avirulence gene NSm for resistance test are preserved in Yunnan Academy of Tobacco Agricultural Sciences. For the preparation method of *Agrobacterium* EHA105 carrying the avirulence gene NSm, see Chinese patent no. ZL201710414755.X, titled "A Method for Identifying Tobacco Resistance Using the Tomato Spotted Wilt Virus NSm Gene". The entire content of this patent is incorporated herein by reference.

Reagents: All molecular biology-related reagents, instruments and consumables are commercially available products.

Example 1. Acquisition of BC6F2 Segregation Population and Definition of TSWD Resistance with Linkage Drag The material 'Polalta' (5) carrying RTSW spotted wilt disease resistance locus was used as the donor parent to cross with the main susceptible variety '1(326' (?) (*N tabacum* cv. K326) as the recipient parent, and the progeny backcrossed with the recurrent parent 1(326' for 5 generations. Homozygous tobacco backcrossing and self-crossing generation BC5F3 was obtained by selecting disease resistance traits. After multiple generations of backcrossing, the resistance to TSWD was stable, but the deformed phenotypes still existed without any elimination. Deformed phenotypes included growth retardation, dwarfing of plants, and leaf deformations including thickened veins, irregular distortions of veins, thickened leaves and veins, narrow leaves, etc., as well as varying degrees of reduced fertility, such as decreased seed setting rate, shriveled fruit and decreased seed quantity of a single fruit (FIG. 1). The homozygous BC5F3 tobacco was used as the donor parent and the main susceptible variety 1(326' was used as the recurrent parent to continue backcrossing to obtain BC6F1 population, and BC6F1 population was self-crossed to obtain BC6F2 population. Using the avirulence gene induced HR method established by our team, 454 plants in the BC6F2 population were subjected to TSWD resistance identification. The avirulence gene induced HR method was the method for identifying tobacco resistance using the TSWV NSm gene that was recorded in the Chinese patent no. ZL201710414755.X, titled "A Method for Identifying Tobacco Resistance Using the Tomato Spotted Wilt Virus NSm Gene". The specific steps were as follows:

(1) culturing *Agrobacterium* EHA105 carrying the avirulence gene NSm expression vector in *Agrobacterium tumefaciens* medium LB at 28° C. for 24 hours, collecting bacterial cells by centrifugation, and then diluting the bacterial cells with infiltration buffer (10 mmol/L $MgCl_2$, 10 mmol/L MES, 200 μmol/L acetosyringone) to obtain a bacterial suspension with an $OD_{600}$ of 0.5;

(2) using a sterile syringe without needle to inject 9.5-10.5 microliters of the bacterial suspension between leaf veins from the leaf back of a tobacco plant to form a visible infiltration zone; inoculated tobacco plants were cultured with 20-28° C., 80% humidity and 16/8 light cycles for 72 hours.

(3) observing; if the tobacco plant showed typical hypersensitive reaction (HR) induced by the identified strain carrying the avirulence gene NSm expression vector, the tobacco plant was identified as a disease-resistant plant relative to the avirulent gene NSm.

By NSm mediated disease resistance identification, among the 454 plants of BC6F2 population, 319 plants showed HR phenotype and were resistant plants (indicated by RTSW), while 118 plants did not show HR phenotype and were susceptible plants (indicated by rtsw), and the other 17 plants were too small for HR test, so they were not included in the statistics.

Next, the genetic relationship of TSWD resistance locus was further verified using the HR test results. A chi-square test was performed on the resistance traits of the BC6F2 population. Under the premise that the expected ratio was 3:1, $\chi^2$=0.9344, when df=1, $\chi^2$0.05=0.3337, the test result $\chi^2$>0.3337, indicating it was not a significant difference. It was proved that the segregation of resistance traits in the BC6F2 population conformed to Mendel's law of inheritance. By chi-square test, it can be determined that RTSW gene-mediated resistance to TSWD is a single dominant gene (see Table 1 for the results).

TABLE 1

Segregation ratio of resistance traits in BC6F2 population

| Generation (Population) | HR (Resistant, RTSW) | No HR (Susceptible, rtsw) | Expected ratio | Chi-square value | Degree of freedom (df) | Progressive significance |
|---|---|---|---|---|---|---|
| BC6F2 | 319 | 118 | 3:1 | 0.9344 | 1 | 0.333722 |

Meanwhile, phenotype observation and statistical analysis of deformity was carried out. Based on the deformed phenotypes, the genetic relationship of the deformity locus was further verified. In the statistical process of deformed phenotypes, all abnormal leaves and plant development phenotypes were classified as deformed phenotypes and represented by DEF (Deformity), and phenotypes that plant development was completely normal without any deformations were classified as normal phenotypes and represented by def. A chi-square test was performed on the resistance traits of the BC6F2 population. The deformity (DEF): the normal (def) was 417:37=11.27:1, which was much higher than 3:1 and closer to a segregation ratio of 15:1. Under the premise that the expected ratio was 15:1, $\chi^2$=2.79, when df=1, $\chi^2_{0.05}$=0.094, the test result $\chi^2$>0.094, indicating that the difference was not significant. It was proved that the deformity traits in the BC6F2 population conformed to Mendel's law of inheritance, and was possibly determined by two loci.

The subpopulation BC6F2:S consisting of all susceptible plants in the BC6F2 population was also analyzed. There were 118 susceptible plants in the BC6F2:S population, and among them the deformity (DEF): the normal (def) was 81:37=2.18:1, which was closer to a segregation ratio of 3:1. Therefore, under the premise that the expected ratio was 3:1, $\chi^2$=2.54, when df=1, $\chi^2_{005}$=0.111, the test result $\chi^2$>0.111, indicating that the difference was not significant, and it was proved that the susceptible sub-population BC6F2: S conformed to Mendel's single-gene inheritance law (see Table 2 for the results).

TABLE 2

Segregation ratio of deformed phenotypes in BC6F2 population

| Generation (population) | Deformity | Normal | Expected ratio | Chi-square value | Degree of freedom (df) | Progressive significance |
|---|---|---|---|---|---|---|
| BC6F2 | 417 | 37 | 15:1 | 2.7964 | 1 | 0.094472 |
| BC6F2: S (susceptible) | 81 | 37 | 3:1 | 2.542 | 1 | 0.111 |

The results of phenotype analysis and chi-square test showed that the deformed phenotypes in the population were controlled by multiple genes, probably by two loci.

Figure 2:
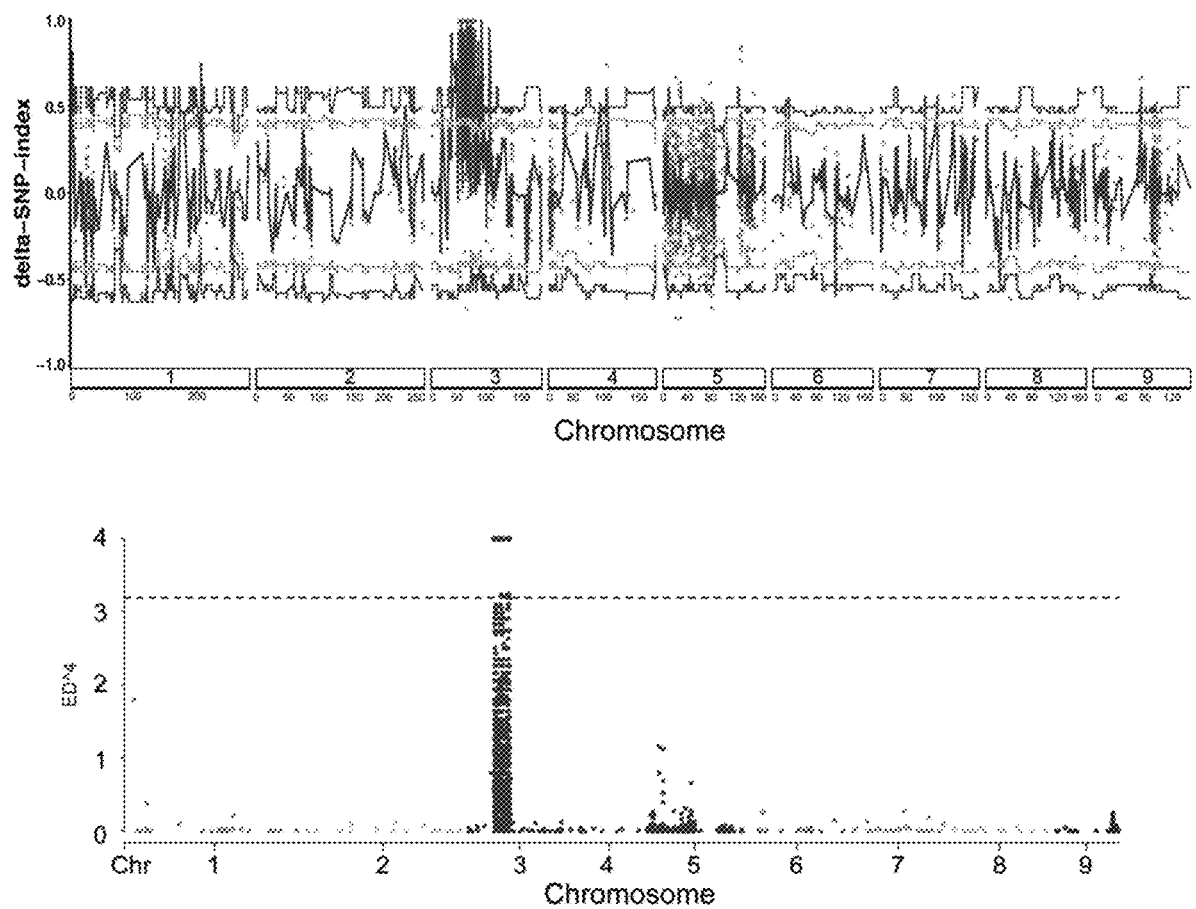
FIG. 2 shows the distribution of SNP sites between resistant pool (RTSW-pool) and susceptible pool (rtsw-pool) on chromosome 3 of *N alata* genome from 43.7 Mb to 64.8 Mb (Chr3: 43.7-64.8 Mb) that is found by analysis using algorithms of delta SNP-index and Euclidean distance (ED).

Example 2. Preliminary Localization of TSWD Resistance Locus and Molecular Marker Development In order to eliminate the interference of deformed phenotypes on localization of TSWD resistance locus, 40 deformed plants were randomly selected from 319 resistant plants to construct a resistant pool (RTSW-pool) and 40 deformed plants were randomly selected from 118 susceptible plants to construct a susceptible pool (rtsw-pool). 0.1 g leaves from each of the selected 40 plants were taken, and a total of 4 g leaves were mixed to form the RTSW-pool or rtsw-pool. The DNA of each pool was sequenced. The resistant parent 'Polalta' and the susceptible parent 'K326' were also sequenced. The sequencing depth was 30×, and 135G data was sequenced for each sample. Sequencing was performed using the BGI500 sequencing platform of BGI. The clean reads of the resistant pool and the susceptible pool obtained by whole genome sequencing were mapped to the chromosome level genome of Nalata respectively and analyzed by Bulked Segregant Analysis (BSA). Using delta SNP-index, a total of 7774 SNP sites between the resistant pool and the susceptible pool with a Delta value greater than 0.5 and a significance greater than 99% were found, of which 7732 SNP sites were distributed on chromosome 3 of the Nalata genome from 43.7 Mb to 64.8 Mb (Chr3: 43.7-64.8 Mb). The same result was also obtained by using Euclidean distance (ED) algorithm (see FIG. 2).

Example 3. Development and Verification of Molecular Markers of TSWD Resistance Locus According to the SNP distribution obtained from the BSA data of the resistant pool/susceptible pool, we believe that the resistance introgressed segment in the TSWD resistant tobacco in the BC6 population is derived from chromosome 3 of the Nalata genome from 43.7 Mb to 64.8 Mb, and its size is 21.1 Mb. In order to further decrease the size of the introgressed segment, molecular markers near the left end and the right end of the introgressed segment were developed (Table 3).

TABLE 3

Molecular markers of the resistance introgressed segment (1)

| Marker name | Primer name | Primer sequence (5'-3') | Position of the marker in the introgressed segment |
|---|---|---|---|
| NaChr3_44.2M | NaChr3_44.2MF | CTCTGCCTAGAT GTTGTTAATTGC (SEQ ID No. 12) | At the left end |
|  | NaChr3_44.2MR | GGATATGTCCGT AGATTTGGTTGA (SEQ ID No. 13) |  |
| NaChr3_64.6M | NaChr3_64.6MF | GCTGCTCAAACT GGCTTATGA (SEQ ID No. 26) | At the right end |
|  | NaChr3_64.6MR | CTAATAGATGCT CGTGACTTGTGA (SEQ ID No. 27) |  |
| NaChr3_65.7M | NaChr3_65.7MF | AGCATAAAGGTC GGAAGGAAGAAAGC (SEQ ID No. 28) | On the flank of the right end |
|  | NaChr3_65.7MR | TGACGGCTGATG ACGCATATCTCTA (SEQ ID No. 29) |  |

In order to verify the validity of the markers, N alata, TSWD resistant plant 'Polalta', TSWD susceptible variety '1(326', BC6F1 population and 437 plants of BC6F2 that have been identified as resistant or susceptible to TSWD were selected for marker verification. The method of marker verification was as follows: Leaf genomic DNA was extracted from a tobacco plant to be tested using Plant Genomic DNA Extraction Kit (TIANGEN Biotech, Cat. no. DP360) according to the operating steps described in the manual of the kit. For each marker, PCR amplification was performed using the leaf genomic DNA of the tobacco plant to be tested as a template and a primer pair consisting of two single-stranded DNA. The PCR reaction system was as follows: 2×Premix Ex TaqMix PCR Buffer (Takara, Cat. no. RR003A) 12.5 µL, 10 µmol/L forward primer 0.5 µL, 10 µmol/L reverse primer 0.5 µL, 50 ng/µL template DNA 1 µL, adding sterile double distilled water to a total volume of 25 µL. The PCR reaction procedure was as follows: pre-denaturation for 5 min at 94° C.; followed by 35 cycles: denaturation for 30 s at 94° C., annealing for 30 s at 55° C., extension for 30 s at 72° C. and a final elongation step for 10 min at 72° C. After reaction, the PCR product was identified by electrophoresis using ZAG DNA analyzer system (Agilent, M5320AA). If the expected PCR product was detected, the test result of the marker was positive; if the expected PCR product was not detected, the test result of the marker was negative. The above-mentioned method of marker verification is applicable to verification or detection of all the markers disclosed herein.

The results showed that NaChr3_65.7M marker was positive in N alata and 'Polalta', but negative in other tobacco plants 1(326', BC6F1 and BC6F2 populations. NaChr344.2M and NaChr3_64.6M markers were positive in tobacco 'Polalta', N alata, BC6F1 population and 319 BC6F2 tobacco plants resistant to TSWD, but negative in 1(326' and 118 susceptible BC6F2 tobacco plants. These markers are tightly linked to TSWD resistance, and co-segregate with TSWD resistance phenotype in each generation. Moreover, these markers are located at both ends of the resistance introgressed segment and can be used for the later detection of shortening of the resistance introgressed segment.

Example 4. Preliminary Localization of Linkage Drag Loci and Molecular Marker Development By resistance screening and deformed phenotype observation, the BC6F2 population can be preliminarily divided into three subpopulations: deformed resistant (genotype: DEF_RTSW), deformed susceptible (genotype: DEF_rtsw) and normal susceptible (genotype: def_rtsw). No plants with both normal phenotype and disease resistance (genotype: def RTSW) were found. 40 plants were selected from each of the three subpopulations to construct a deformed resistant pool (DEF_RTSW_pool), a deformed susceptible pool (DEF_rtsw_pool) and a normal susceptible pool (def_rtsw_pool) respectively. The construction method was taking 0.1 g leaves from each of the selected 40 plants, and mixing a total of 4 g to form a pool for DNA resequencing. The sequencing depth was 30×, and 135G data was sequenced for each pool.

Figure 3:
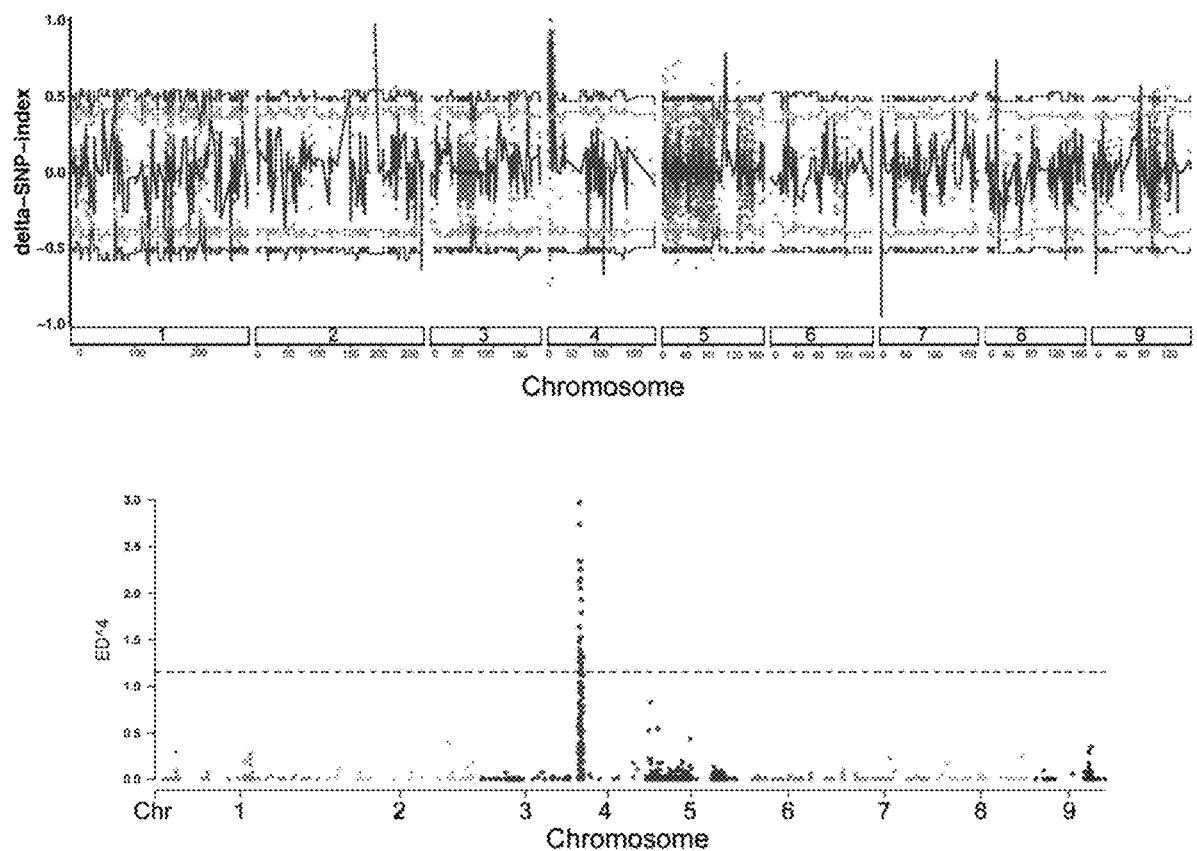
FIG. 3 shows the analysis results of deformed susceptible pool (DEF_rtsw_pool) and normal susceptible pool (def_rtsw_pool) using algorithms of delta SNP-index and Euclidean distance (ED). By Bulked Segregant Analysis (BSA), it was found that the DEF1 locus causing deformations was located at the end of chromosome 4 in the range of 1-8.6 Mb.

After the previous genetic analysis of the segregating population, it was preliminarily determined that the deformed phenotypes were determined by two dominant loci. For accurate localization of the first deformity locus (DEF1), the deformed susceptible pool (DEF_rtswpool) and the normal susceptible pool (def_rtswpool) were first selected for analysis to exclude the interference of the TSWD resistance locus. The whole genome sequencing data of the two pools and the parents was aligned to the genome of N alata, and delta SNP-Index and ED analysis was performed (FIG. 3). Through SNP typing, it was found that the deformity locus DEF1 was located in the range of 1-8.6 Mb at the end of chromosome 4 of the N alata genome. According to the whole genome sequencing results, two markers respectively near the left end and right end of the introgressed segment were developed (Table 4), which were located at 2 Mb and 8 Mb on chromosome 4 of the N alata genome.

TABLE 4

Molecular markers at both ends for the first deformity locus (DEF1) introgressed segment

| Marker name | Primer name | Primer sequence (5'-3') | Position of the marker in the introgressed segment |
|---|---|---|---|
| NaChr4_2M | NaChr4_2MF | TTGATGAC CTCGGTGA CCACTT (SEQ ID No. 30) | At the left end |
| | NaChr4_2MR | GGTCGATG AACTTGGC GTTGT (SEQ ID No. 31) | |
| NaChr4_8M | NaChr4_8MF | TGACTTCCA TATTGAGAA GCCGATTGA (SEQ ID No. 32) | At the right end |
| | NaChr4_8MR | GAGATCCGT CTGTACGAC TACCTGTA (SEQ ID No. 33) | |

Using these markers and combined with TSWD resistance identification, 'Polalta', N alata, '1(326', BC6F1, and 118 BC6F2 tobacco plants that were deformed susceptible (DEF_rtsw) and normal susceptible (def_rtsw) were selected for marker verification. The method of marker verification was the same as shown in Example 3.

The results showed that in N alata, 'Polalta', BC6F1 and 81 deformed susceptible (DEF_rtsw) BC6F2 tobacco plants, the test results of NaChr4_2M and NaChr4_8 M markers were positive, which were completely consistent with the deformed phenotype; and in 1(326' and 37 BC6F2 tobacco plants that were normal susceptible (def_rtsw), the test results of the markers were negative, which were consistent with the normal phenotype. The NaChr4_2M and NaChr4_8 M markers are located at both ends of the resistance introgressed segment and are completely linked to the DEF1 locus, so they can be used for the detection of the DEF1 locus.

Example 5. Determination of the Second Deformity Locus (DEF2)

In order to find the second deformity locus, the obtained molecular markers (NaChr4_2M and NaChr4_8 M) located at both ends of the first deformity locus (DEF1) introgressed segment were used to screen plants with deformed phenotypes, and tobacco plants that did not possess the DEF1 introgressed segment were selected. 40 plants were randomly selected from the tobacco plants that did not possess the DEF1 introgressed segment to form a mixed pool (DEF2 pool) for whole genome sequencing. BSA was performed on the obtained whole genome sequencing data and the completely normal mixed pool (def pool). Delta SNP-Index and ED analysis was performed. The clean reads of DEF2 pool and def pool obtained by whole genome sequencing were mapped to the *N. alata* genome, and it was found that the deformity locus DEF2 and the resistance locus (RTSW) were in the same region. Both DEF2 and RTSW loci were located on chromosome 3 of the Nalata genome from 43.7 Mb to 64.8 Mb, suggesting that the DEF2 locus and the RTSW locus overlapped. 319 deformed plants of the BC6F2 population that did not possess the first deformity locus (DEF1) were detected using the molecular markers at both ends of the resistance introgressed segment, and the marker detection results were completely consistent with the deformed phenotype, indicating that the DEF2 locus should be tightly linked to the RTSW locus and located near the RTSW locus.

Example 6. Screening of Plants with Short Resistance Introgressed Segment

Primers NaChr344.2MF/NaChr344.2MR of the marker at the left end of the resistance introgressed segment and primers NaChr3_64.6MF/NaChr3_64.6MR of the marker at the right end of the resistance introgressed segment were used for screening from a backcrossing population. The heterozygous (RTSW/rtsw) plant of BC5F2 (BC5F2-4Q) as donor parent was crossed with the recurrent parent 1(326' to produce BC6F1 backcross population. 1500 plants of the BC6F1 population were recruited for marker screening. If both markers are negative or positive, these plants were non-recombination individuals. If one marker is positive and another marker is negative, these plants were recombination events. For the primer pair NaChr344.2MF/NaChr344.2MR, the resistant control *N alata* and 'Polalta' generated a 470 bp amplified product, and the susceptible control 1(326' had no amplification, indicating that the PCR amplification was specific. The primer pair NaChr3_64.6MF/NaChr3_64.6MR was also used for amplification, the resistant control *N alata* and 'Polalta' obtained 494 bp amplified product, and the susceptible control 1(326' was negative, indicating that the PCR amplification was specific. DNA was extracted from leaves of 1500 plants of BC6F1 backcross population for PCR verification of markers. The method of marker verification was the same as that in Example 3. Finally, two plants (No. 46 and No. 364) were detected as negative for NaChr344.2M marker but positive for NaChr3_64.6 M marker, and one plant (No. 59) was detected as positive for NaChr344.2M marker but negative for NaChr3_64.6 M marker. By TSWD resistance identification (the method was the same as that in Example 1), we found that plant No. 59 was susceptible to TSWD as it did not show HR after inoculation with avirulence gene, meanwhile plants No. 46 and No. 364 showed HR after inoculation with avirulence gene. The results showed No. 46 and No. 364 plants were TSWD resistance plants, and they were preliminarily determined as plants with effective shortened resistance introgressed segment. In order to clarify the shortened size of the resistant introgressed segment in tobacco plants No. 46 and No. 364, more molecular markers were developed (Table 5).

TABLE 5

Molecular markers of resistance introgressed segment (2)

| Marker name | Primer name | Primer sequence |
|---|---|---|
| NaChr3_54M | NaChr3_54MF | GTGGAGGATACGA TTACGCCTGTC (SEQ ID No. 14) |
| | NaChr3_54MR | GCCATCATTAAC TGCTTGACCAAC C (SEQ ID No. 15) |
| NaChr3_57M | NaChr3_57MF | GGGTGTGTTTCG GGTTGTGAATCC (SEQ ID No. 16) |
| | NaChr3_57MR | CAGTTTCCGCTT CCACGGTTTGA (SEQ ID No. 17) |
| NaChr3_58M | NaChr3_58MF | GCACGCCGTCCA CTTTGAATG (SEQ ID No. 18) |
| | NaChr3_58MR | ACGAGGCTAGAC AGGACCTACAA (SEQ ID No. 19) |
| NaChr3_59M | NaChr3_59MF | GCATTGTTCCGA CTTGTAGAATCC TT (SEQ ID No. 20) |
| | NaChr3_59MR | GTGCCAATAGTTA CCACTGTTCCAA (SEQ ID No. 21) |

The size of the resistance introgressed segments carried by the plants No. 59, No. 46 and No. 364 were detected using these molecular markers, and the results were shown in Table 6.

TABLE 6

Test results of markers in recombination plants

| Individual plant | Marker name | | | | | | | Resistance identification |
|---|---|---|---|---|---|---|---|---|
| | NaChr3_44.2M | NaChr3_54M | NaChr3_57M | NaChr3_58M | NaChr3_59M | NaChr3_64.6M | NaChr3_65.7M | |
| 59# | Pos | Neg | Neg | Neg | Neg | Neg | Neg | No HR |
| 46# | Neg | Neg | Neg | Neg | Pos | Pos | Neg | Has HR |
| 364# | Neg | Neg | Neg | Pos | Pos | Pos | Neg | Has HR |

TABLE 6-continued

Test results of markers in recombination plants

| Individual plant | Marker name | | | | | | | Resistance identification |
|---|---|---|---|---|---|---|---|---|
| | NaChr3_44.2M | NaChr3_54M | NaChr3_57M | NaChr3_58M | NaChr3_59M | NaChr3_64.6M | NaChr3_65.7M | |
| *N. alata* | Pos | Pos | Pos | Pos | Pos | Pos | Pos | Has HR |
| 'Polalta' | Pos | Pos | Pos | Pos | Pos | Pos | Pos | Has HR |
| 'K326' | Neg | Neg | Neg | Neg | Neg | Neg | Neg | No HR |

Note:
"59#", "46#" and "364#" in the table represent "plant No. 59", "plant No. 46" and "plant No. 364" respectively. "Pos" means positive, "Neg" means negative, and "HR" means hypersensitive reaction. "Has HR" means having TSWD resistance, and "No HR" means not having TSWD resistance.

From Table 6, we found that plant No. 46 contains a shorter resistance introgressed segment. NaChr344.2M, NaChr3_54M, NaChr3_57M, and NaChr3_58M are negative in plant No. 46. It means the introgressed segment has been shortened by more than 14 Mb in plant No. 46. By resistance identification, it was speculated that the resistance gene locus should locate between 58 Mb and 64.8 Mb on Chr3 of the *N alata* genome.

The molecular markers (NaChr4_2M and NaChr4_8M) located at both ends of the first deformity locus (DEF1) introgressed segment were used to detect plant No. 46 and the result was positive. Since plant No. 46 carried the DEF1 locus, it still had a severe deformed phenotype. Our results indicated that the DEF1 locus and RTSW (DEF2) locus were located on different chromosomes and should be segregated separately. Therefore, we tried to screen plants carrying only the RTSW (DEF2) introgressed segment among the progenies of plant No. 46. 248 plants of F2 self-crossing segregating population of plant No. 46 were subjected to screening, and a total of 60 plants carrying only the RTSW (DEF2) locus but no DEF1 locus were obtained. However, all of these 60 plants still showed severe deformed phenotypes. Among them, 34 plants were unable to bloom at all, and other 26 plants were delayed in flowering and few-flowered. Among them, 4 plants had only 1-2 flowers with low seed setting rate and seed quantity.

Example 7. Genetic Relationship of Linkage Drag Loci

Figure 4:
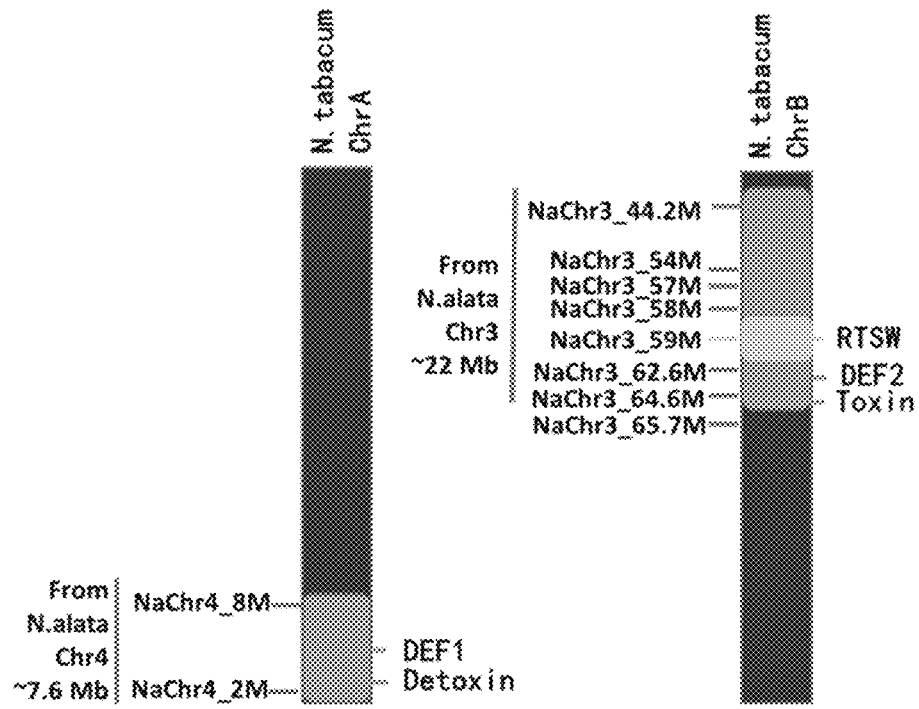
FIG. 4 shows the predicted genetic models of DEF1 and RTSW (DEF2) loci. DEF1 locus is derived from 1-8.6 Mb of chromosome 4 of wild tobacco *N alata*. DEF2 locus is tightly linked to the resistance locus (RTSW locus). They are located at the same locus that is derived from 43.7 Mb to 64.8 Mb of chromosome 3 of *N alata*. It is speculated that there may be a tightly linked toxin gene (Toxin) near the RTSW (DEF2) locus, and the existence of RTSW (DEF2) locus alone may lead to heavier deformed phenotype or impaired fertility, while DEF1 locus may be tightly linked to a detoxin gene (Detoxin), and only in the presence of DEF1 locus, RTSW (DEF2) locus can be inherited stably. The markers used in the invention have been marked in the figure.

According to the analysis of the disease resistance locus (RTSW) and the deformity loci (DEF), the genetic relationship between the RTSW locus and DEF loci was preliminarily revealed. We found that the deformed phenotype was determined by two loci. DEF1 was derived from 1-8.6 Mb on chromosome 4 of the genome of the wild tobacco *N alata*. The other locus (DEF2) was tightly linked to the resistance locus (RTSW) and located on the same genome region, 43.7 Mb to 64.8 Mb, of *N alata* Chr3. In the continuous backcrossing process of multiple generations, the DEF1 locus and RTSW (DEF2) locus showed co-segregation all the time. Through investigation of the F2 segregated population of plant No. 46, we speculate that the DEF1 locus is essential for the surviving of RTSW (DEF2) locus. If there is only RTSW (DEF2) locus, plants will show more severe deformity and poor fertility. If DEF1 and RTSW (DEF2) loci co-exist, plants will show severe deformed phenotypes, but the fertility is not significantly different from that of the parents 'Polalta' and 1(326'. Therefore, we proposed the following model: there may be a toxin gene (Toxin) near the RTSW (DEF2) locus, which alone may cause a more severe deformed phenotype and sterility, while there may be a detoxin gene (Detoxin) at the DEF1 locus. The RTSW (DEF2) locus can be stably inherited only in the presence of the DEF1 locus (FIG. 4).

Example 8. Simultaneous Removal of Two Linkage Drag Loci by Screening from a Super Large Population According to our model, there may be a toxin gene near the RTSW (DEF2) locus, which alone may cause a more severe deformed phenotype and sterility, while there may be a detoxin gene at the DEF1 locus, and the RTSW (DEF2) locus can be inherited stably only in the presence of the DEF1 locus. Therefore, in order to segregate the DEF1 locus, it is necessary to segregate the gene segment that causes sterility at the RTSW (DEF2) locus simultaneously. In order to obtain a completely normal plant, the DEF2 locus must also be segregated. However, the introgressed segments of DEF1 and RTSW (DEF2) derived from wild tobacco *N alata* have low homology with the sequence in cultivated tobacco, so recombination inhibition will occur, resulting in a low recombination rate. In order to shorten the introgressed segments of DEF1 and RTSW (DEF2) simultaneously and obtain completely normal resistant plants, it is necessary to screen a huge segregation population. Deformed phenotypes can be used as the visible marker for screening at the seedling stage. For phenotypic screening, the BC7F1 backcross population was produced by using plant No. 46 as the male parent (RTSW(DEF2)/rtsw(def2), DEF1/def1 genotype) and 1(326' as the female parent, and were seeded in the seedling pond, with 1600 floating plates, about 100 seeds per plate. A total of more than 160,000 seedlings were subjected to screening. During the seedling stage, for deformed phenotypes, a total of 5 rounds of screening were carried out. Once the deformed seedlings were observed, they would be discarded during the screening. After critical screening, 12,000 completely normal seedlings were finally obtained for the next molecular marker screening.

Figure 5:
FIG. 5 shows part of the results of screening using molecular markers NaChr3_59M and NaChr3_64.6 M located at both ends of the resistance introgressed segment of plant No. 46. Molecular markers at both ends of the RTSW (DEF2) locus were used simultaneously to screen. Using an optimized molecular marker screening system, 18 plants comprising at least one of the molecular markers NaChr3_59M and NaChr3_64.6 M were obtained.

Genomic DNA was extracted from the 12,000 tobacco plants for marker screening. First, molecular markers NaChr3_59M and NaChr3_64.6M located at both ends of the resistance introgressed segment of plant No. 46 were simultaneously used for screening. Using our optimized molecular marker screening system, 18 plants with at least one of the markers (NaChr3_59M and NaChr3_64.6M) positive were obtained (FIG. 5).

Next, the 18 plants were further tested using the markers at the DEF1 locus (NaChr4_2M and NaChr4_8M). All the plants were negative for primer pairs NaChr4_2MF/NaChr4_2MR and NaChr4_8MF/NaChr4_8MR, indicating that all the plants do not contain the DEF1 locus.

These 18 plants were then submitted to identify the resistance property to TSWD by using avirulence gene mediated HR (described in Example 1). By transiently expressing the avirulent gene NSm and observing the HR response, it can be determined whether there is a resistance introgressed segment. Finally, 5 plants that could be induced HR response when the avirulent gene was expressed were screened out of the 18 plants. The 5 plants have TSWD resistance, named as plant No. 1, plant No. 4, plant No. 11, plant No. 12, and plant No. 17.

In order to detect the size of the resistance introgressed segment carried by the 5 plants and select the shortest resistance introgressed segment for future breeding program, more molecular marker detection on the 5 selected resistant plants were carried out. Using the sequence of the genome, two new pairs of molecular marker primers were further developed for detection based on the resistance introgressed segment (Table 7).

TABLE 7

Molecular markers of the resistance introgressed segment (3)

| Marker name | Primer name | Primer sequence (5'-3') |
|---|---|---|
| NaChr3_60M | NaChr3_60MF | TCTTACCTCTCCT ACTACTCCTCCAT C (SEQ ID No. 22) |
|  | NaChr3_60MR | GCATCTTCTTCTTC TCCGTATCTCCAA (SEQ ID No. 23) |
| NaChr3_62.6M | NaChr3_62.6MF | CTTAGCAGGCAACC AGACAG (SEQ ID No. 24) |
|  | NaChr3_62.6MR | GAGAATGAGCAAGA GAATGTGTTAG (SEQ ID No. 25) |

It was found that plant No. 12 carried the shortest resistance introgressed segment. Plant No. 12 was only positive for NaChr3_59M marker, but negative for other markers (Table 8).

Figure 6:
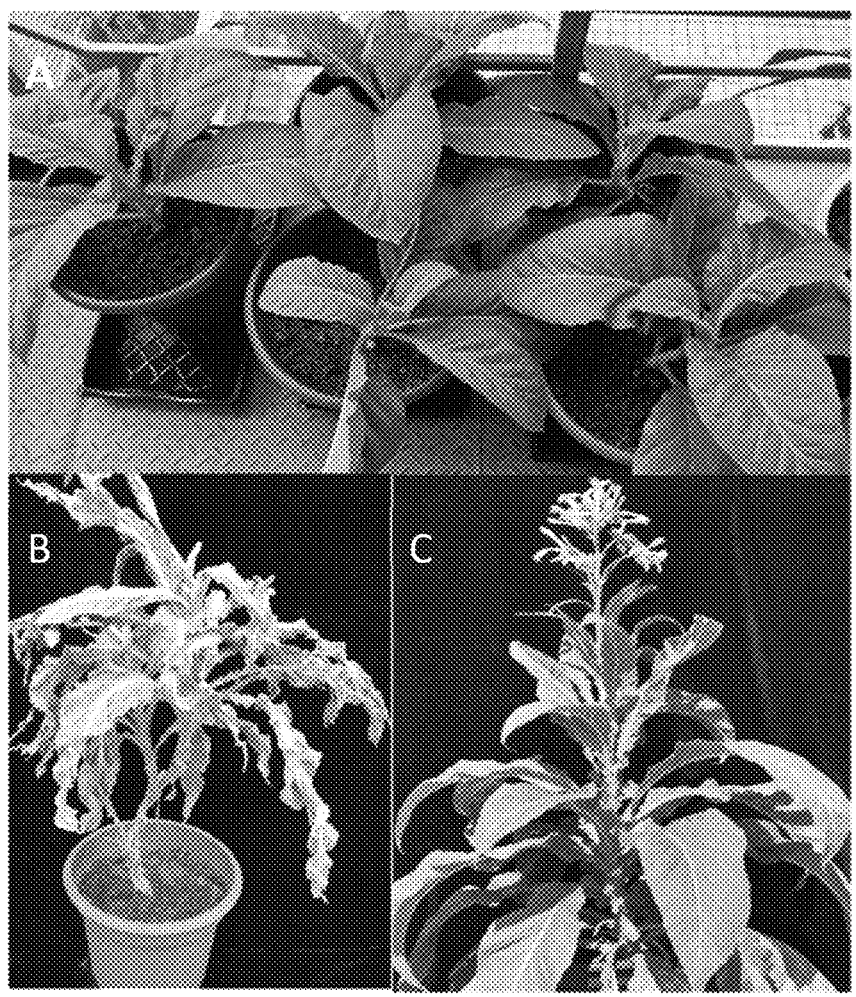
FIG. 6 shows the phenotype in the rosette stage and the adult stage. A, 5 plants, carrying RTSW resistance locus and breaking linkage drag, obtained from 160,000 tobacco screening. B, a typical TSWD resistance tobacco with linkage drag. C, the adult plant phenotype of plant No. 12; its main agronomic traits such as plant height, leaves and flowering period are the same as those of the elite cultivar 'K326'.

Example 9. Phenotype and TSWD Resistance Test of Self-Crossed Progenies of the Plant without linkage drag Whether the phenotype is completely restored to normal is the key point of the invention. Therefore, the phenotypes of the 5 resistant plants (No. 1, No. 4, No. 11, No. 12, and No. 17) selected in Example 8 were observed at seedling stage and adult stage. The observation results showed that the phenotypes of the 5 resistant plants at seedling stage and adult stage had no visible linkage drag, the morphology improved significantly, and the main agronomic traits such as plant height, leaves and flowering period were no significant different with the cultivar 'K326' (FIG. 6).

In order to detect whether the resistance introgressed segment still confers complete resistance to TSWV, self-crossed progenies of the plant No. 12 were inoculated with TSWV. The self-crossed progenies of the plant No. 12 were genotyped using molecular marker detection primers NaChr3_59MF/NaChr3_59MR. The plants that were positive or negative for the molecular marker were selected for rubbing inoculation with TSWV, and the symptoms were observed at two weeks postinoculation. Uninoculated systemic leaves at the top of the plants were collected for virus detection by ELISA. The method was as follows: (1) took 1-2 g TSWV source, put it in a mortar, added 5-10 mL of TSWV inoculation buffer (0.1M pH 7.0 phosphate buffer sterilized at 121° C. for 20 minutes; Within half an hour before inoculation, added 0.2 g sodium sulfite and 10 uL beta-mercaptoethanol per 100 mL phosphate buffer to make TSWV inoculation buffer and placed it on ice) and 2-3 g of carborundum (200-400 mesh), fully ground on ice until they were evenly mixed to obtain TSWV inoculum. For mechanical inoculation, carborundum (200-400 mesh) was first evenly sprinkled on the surface of a tobacco leaf to be inoculated at an amount of 0.1-0.2 g per leaf, then held the tobacco leaf to be inoculated with one hand, and rubbed the TSWV sap gently and evenly with the other hand from the base to the tip of the tobacco leaf to be inoculated; the dosage of TSWV inoculum was 50-100 ul per leaf; (2) after rubbing, rinsed the inoculated leaves with water, then cultivated the plants in the dark under a temperature of 22-25° C. with humidity of 60-80% for one day, and then moved the plants to growth chamber with a temperature of 22-25° C.,

TABLE 8

Marker detection results of recombination plants

| Plant | Marker name | | | | Resistance identification | Phenotype |
|---|---|---|---|---|---|---|
|  | NaChr3_59M | NaChr3_60M | NaChr3_62.6M | NaChr3_64.6M |  |  |
| 1# | Pos | Pos | Pos | Neg | Has HR | Normal |
| 4# | Pos | Pos | Neg | Neg | Has HR | Normal |
| 11# | Pos | Pos | Pos | Neg | Has HR | Normal |
| 12# | Pos | Neg | Neg | Neg | Has HR | Normal |
| 17# | Pos | Pos | Pos | Neg | Has HR | Normal |
| BC6F1-46# | Pos | Pos | Pos | Pos | Has HR | Deformed |
| *N. alata* | Pos | Pos | Pos | Pos | Has HR | Not defined |
| 'Polalta' | Pos | Pos | Pos | Pos | Has HR | Deformed |
| 'K326' | Neg | Neg | Neg | Neg | No HR | Normal |

Note:
"1#", "4#", "11#", "12#" and "17#" in the table represent "plant No. 1", "plant No. 4", "plant No. 11", "plant No. 12", "plant No. 17" respectively. "Pos" means positive, "Neg" means negative, and "HR" means hypersensitive reaction. "Has HR" means having TSWD resistance, and "No HR" means not having TSWD resistance.

a photoperiod of 14h day/10h night, and a humidity of 80%; (3) from the 9th day after inoculation, took fresh tobacco leaves every 7 days and used the double antibody sandwich ELISA method (Agdia, Cat. No. SRA 39300/0096) to detect TSWV and calculated the incidence of TSWD "a"; a total of four tests were performed. In order to reduce the error of human operation, for ELISA test, each sample was repeated three times. The operation steps of the double antibody sandwich ELISA method were carried out according to the instructions (Agdia, Cat. No. SRA 39300/0096).

Figure 7:
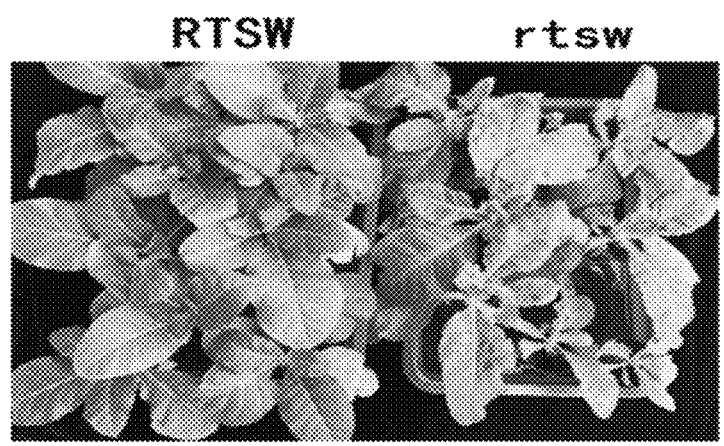
FIG. 7 shows virus inoculation test of self-crossed progenies of plant No. 12. Self-crossed progenies of plant No. 12 were genotyped using amplification primers NaChr3_59MF/NaChr3_59MR for NaChr3_59M molecular marker. Plants that comprise the molecular marker (marked as RTSW in the figure) and those that do not comprise the molecular marker (marked as rtsw in the figure) were selected and inoculated with Tomato spotted wilt virus (TSWV) by rubbing, and TSWV symptoms were observed at two weeks postinoculation. It was found that the plants carrying the resistance introgressed segment were completely resistant to the disease, and the plants without the resistance introgressed segment were 100% diseased.

The total number of infected plants was the total number of positive plants in the four tests. Incidence "a"=(number of susceptible plants of the variety/total number of plants of the variety)×100%. The results of genotyping, symptom observation after inoculation and ELISA test showed that 12 plants carrying the resistance introgressed segment (detected as positive for NaChr3_59M marker) were completely resistant to the disease, while 12 plants without the resistance introgressed segment (detected as negative for NaChr3_59M marker) were 100% susceptible (FIG. 7).

Example 10. Analysis of Agronomic Traits of Materials without Linkage Drag

The plant No. 12 carrying the shortest RTSW introgressed segment was self-crossed, and the self-crossed progenies were genotyped using molecular marker detection primers NaChr3_59MF/NaChr3_59MR. 1000 homozygous plants (genotype RTSW/RTSW) of F3 generation were growth in the field in 2021 (indicated as K326-RTSW in Table 9), and the cultivar 1(326' was growth as a control. There was no difference between all K326-RTSW plants (carrying the shortest RTSW introgressed segment) and the control plants (cultivar 'K326') in terms of germination rate, survival rate, and field growth at the seedling stage. At the vegetative and reproductive stage, 10 plants were randomly selected to measure plant height, stem circumference, leaf number, leaf length, leaf width and other performances to test the agronomic traits of K326-RTSW (Table 9).

TABLE 9

| Analysis of agronomic traits | | | | | |
|---|---|---|---|---|---|
| | Natural plant height at full flowering stage (cm) | Natural plant height at green fruit stage (cm) | Topping plant height (cm) | Total number of leaves at full flowering stage (blade) | Stem circumference at full flowering stage (cm) |
| K326-RTSW | 133.45 ± 12.08 | 153.9 ± 13.46 | 134.86 ± 10.35 | 26.8 ± 2.48 | 10 ± 0.77 |
| K326 | 139.2 ± 18.61 | 159.2 ± 18.93 | 141.95 ± 8.08 | 26.4 ± 1.28 | 10.23 ± 0.83 |
| p-value | 0.4397 | 0.1022 | 0.1741 | 0.3104 | 0.3329 |
| | Stem circumference at green fruit stage (cm) | Midstalk leaf length at full flowering stage (cm) | Midstalk leaf width at full flowering stage (cm) | Midstalk leaf length at green fruit stage (cm) | Midstalk leaf width at green fruit stage (cm) |
| K326-RTSW | 10.69 ± 0.79 | 71.96 ± 3.46 | 32.44 ± 2.89 | 73.54 ± 4.52 | 32.41 ± 3.06 |
| K326 | 10.51 ± 0.9 | 68.83 ± 4.74 | 34.5 ± 3 | 70.26 ± 5.62 | 32.54 ± 2.66 |
| p-value | 0.2193 | 0.0918 | 0.2003 | 0.5050 | 0.7599 |

From the table, we can find that the linkage drag has been completely segregated from the short RTSW introgressed segment. The obtained K326-RTSW variety carrying the short RTSW introgressed segment had no significant difference from the elite cultivar 'K326' in terms of plant height, stem circumference, number of leaves, leaf length, leaf width and other agronomic traits.

SEQUENCE LISTING (34 sequences)

SEQ ID NO: 1 - DNA, 470 bp, Nicotiana alata
ctctgcctagatgttgttaattgcgatcgcaggtaatcatctgcgatcgcgaagagtaaaagttaaaggctccagaaattgggctatgcgaacacagcttaaggaatgccatcgcagaagaggaagtagcagacatatgtgttcgcgaacagggccacgcgatcgcgaagaggaaaatggccactgagccaccgtctcagtttctactatgcaaacgcgaagaatgggatgcaaacgtgaaggaggagggaatagacttccgcgatcgcgaaccaactaatgcgatcacgtagaacaaaatggtccccctccagaattactctatgcgaatgcggaggaagggctacgatcgcactgaaggaaactagataccagctgttcagcaattcaacaagttccaaaatgatctgttgagcattcgaaacacacccgaggcccccgggacctcaaccaaatctacggacatatcc

SEQ ID NO: 2 - DNA, 214 bp, Nicotiana alata
gtggaggatacgattacgcctgtcgcgcgctaggaggacgtcttatacttagagatgtatgggatgccctttcaacatttttagaccgttacaaccgtttcaagggtgatacgccgattgacggttaaggggccattctatggtgcctgtcataatgacgcacgttactgtatacctgaaccgttttacggttggtcaagcagttaatgatggc

SEQ ID NO: 3 - DNA, 243 bp, Nicotiana alata
gggtgtgtttcgggttgtgaatccgctcttattcgatatttcaatattgcttctttggatataaaagggtactatataaagaaaatgagctcccaattaagttttgtttaaaccattagatccgtatcgaaatttcggagccataggaaaaagaatcgtcgaagttggacatcatatggggaagttatgctcgtttccgtgccgagaaatctggttgctgtcaaaccgtggaagcggaaactg

SEQ ID NO: 4 - DNA, 244 bp, Nicotiana alata
gcacgccgtccactttgaatgttgaatatgggatcgtgtggcgcgccgtccactttgtgcttactgttttacttagagtagtcgtagattaactgctttagcttagtgtactttatgctttagaattgttcccccttacagcatattcccctcccgtatctgtttactttacagtatttcttcctgttgtcgtatgcatatatatcttgcacaggttaacgttgtaggtcctgtctagcctcgt

SEQ ID NO: 5 - DNA, 250 bp, Nicotiana alata
gcattgttccgacttgtagaatccttcagggattgatattacagagttagcatgatttgcatactatttgaactcagtccgaagtttttaacactattttgcaaactcagccatatttctaagttttgaaaactcaaatgacttttaaatgatatttcgggctgatgatcactgttttataaatgcccaagggcttatgacgttttctggactgtatattatgacttggaacagtggtaactattggcac

SEQ ID NO: 6 - DNA, 200 bp, Nicotiana alata
tcttacctctcctactactcctccatctattatttcctcttcctctgatacgccttcataaacaggtccgagtaacagaggtataactatgaggaaggttacgcttaaagttcctgctactcatagtcttttaaggaagactggtggaactgacgtgtggcttgagcctttaattggagatacggagaagaagaagatgc

SEQ ID NO: 7 - DNA, 633 bp, Nicotiana alata
cttagcaggcaaccagacaggcacggtacctggaggacataaaatttcagccaaccacggccgagcttcttctttcaaagctaacttctccaagtaccgtgtctcatcctcatctccgaatcccaagaaatcattgagagtcgtgccatcgaacggaagtcgcttgtctcttacttgagttgtctttgtatcccgaaccaaatggtgaacattggcgtaaaactccttcaccatgtgttcgttggcattctccaacttctccttaaagtacccccagccctcacgtgtgcggaattgggcttgcacacgagggttgtggggaagcagatcactatctatgaacctcctctcgggtatcaattttctgtccggccaccacagcctgaatttagagtaagccgtctcactgatgaatctatcaacccatgcatttgggttcttggttctgtcgatgcccccagttgctggagcaccaccatcactggtactctcttcttcccccgatagagatgctgtggggaaagtggagtactctccttctccagtttcattttcatctccggactcgtcagactggtctgagactgttctgttctctggccgcttggctaacacattctcttgctcattctc

SEQ ID NO: 8 - DNA, 494 bp, Nicotiana alata
gctgctcaaactggcttatgagcattttttggtttatctacgcgtttggtaaataccgaaagtgcttataagccagatacttataagcttaaatcagccataagtcataagctgggcaccatcagcctatgactttttagcttataagcactttagtttgaccaagttttttactagtttatccttaataatattttttatttcacaaaatattttttccaaaataaattttctaactttcttttcatttcatatttgttcttcatctttttctttacaaagaaactttttaatttattgtcacgacccaaaccccgctccggtcgtgatacgcctctcgtgaagacaaggccagccaaaccattacaaaacacctcttttaagcagttaaacagttcataagcagtttaaatatgatttaatgatattaattagcggaagtacaacccaacacagccctaatcggggtgtcacaagtcacgagcatctattag

SEQ ID NO: 9 - DNA, 532 bp, Nicotiana alata
agcataaaggtcggaaggaagaaagctttatctctttaggaaagattaatatcagcttcaaccaaaatcatgtttaatgtatatggactggaaccaaatgttaccaaaagtcaatggttgcagtattttattagtaacaggggctatcatattataatacagatagagagctaattggcaggttataatccattctcattggcctcaaaagtcaatagttacatctgttaatgaataacattgcttagtatattattattagttaatatacaagtcagtcgcttataacgcgatgatcatgcaagccactcctagcaattgcagtagtttcctattattctgtctgtgagatgctgatgatgagatacttcttgctagaagaatatttcagtagtattcagtcgactactatattaaactcgaaatgtagaggctggatattgtatcgttcaaccaacatttattcagaatgggctaatagaacttcttccaagataaaggaagacttagagatatgcgtcatcagccgtca

SEQ ID NO: 10 - DNA, 444 bp, Nicotiana alata
ttgatgacctcggtgaccacttttggctgtggaacccctccacaagagaatcaatagaacttccctgtccagaatctcaatttaaggattatgtatgcgggattggatatgattctactagtgacgactataagatcgttgcgattaacctagaagcgaaaatccatcaggatgtatctgttgaaattctcgcgctaaaaagtggttcttggagaaaaaattgtaaatatcctattggtatccaccgtgtatcgggtggtgctatagatcgtggtatggattctttggcatttgtacatggagcatttcattgggttgcatttcgttgggttggtttatcacgatgttctactatcatttcacttaatatttcaagtgaggtgttcggagagatacccttgatagagcaaatgtgcaatacatacaacgccaagttcatcgacc

SEQ ID NO: 11 - DNA, 621 bp, Nicotiana alata
tgacttccatattgagaagccgattgaaaagtacaatagataacatttctactttgatctatttaatcaatataaattcctaaatctgcaaaaaaaaaaagaaaaaaaaagaactatatccatctgaactattgttctagaatcttaacccaatattatttattttagagatgtactagtatagtacccgcgcgatgcgcggaatatggtagaagaaaaaagtataaaaaattattatcttatttttagctaaatgtaaattttacagatatagtttaatagacagttgacactttagtcattaaaagtttgaattcagcttcctaatatttattttatgtagccaaaaatgccataagttattgtggtatgttcaatgacaaaataattaaacttaacttactataaataatgattagtcatgaggataaaaaaagaattgccgggttatttaattccagaatatcattgacaatttgcattagcatatatggaatccgactctaagataacatgctattcatttcatttgtaacatttcaaaccaacattattggatgcagcatccttctcaaatgactaataaaaatataattacaggtagtcgtacagacggatctc

SEQ ID NO: 12 - DNA, 24 bp, Artificial Sequence
  NaChr3_44.2M????????????
ctctgcctagatgttgttaattgc

SEQ ID NO: 13 - DNA, 24 bp, Artificial Sequence
  NaChr3_44.2M????????????
ggatatgtccgtagatttggttga

SEQ ID NO: 14 - DNA, 24 bp, Artificial Sequence
  NaChr3_54M????????????
gtggaggatacgattacgcctgtc

SEQ ID NO: 15 - DNA, 25 bp, Artificial Sequence
  NaChr3_54M????????????
gccatcattaactgcttgaccaacc

SEQ ID NO: 16 - DNA, 24 bp, Artificial Sequence
  NaChr3_57M????????????
gggtgtgtttcgggttgtgaatcc

SEQ ID NO: 17 - DNA, 23 bp, Artificial Sequence
  NaChr3_57M????????????
cagtttccgcttccacggtttga

SEQ ID NO: 18 - DNA, 21 bp, Artificial Sequence
  NaChr3_58M????????????
gcacgccgtccactttgaatg

SEQ ID NO: 19 - DNA, 23 bp, Artificial Sequence
  NaChr3_58M????????????
acgaggctagacaggacctacaa

SEQ ID NO: 20 - DNA, 26 bp, Artificial Sequence
  NaChr3_59M????????????
gcattgttccgacttgtagaatcctt

SEQ ID NO: 21 - DNA, 25 bp, Artificial Sequence
  NaChr3_59M????????????
gtgccaatagttaccactgttccaa

SEQ ID NO: 22 - DNA, 27 bp, Artificial Sequence
  NaChr3_60M????????????
tcttacctctcctactactcctccatc

SEQ ID NO: 23 - DNA, 27 bp, Artificial Sequence
  NaChr3_60M????????????
gcatcttcttcttctccgtatctccaa

SEQ ID NO: 24 - DNA, 20 bp, Artificial Sequence
  NaChr3_62.6M????????????
cttagcaggcaaccagacag

SEQ ID NO: 25 - DNA, 25 bp, Artificial Sequence
  NaChr3_62.6M????????????
gagaatgagcaagagaatgtgttag

SEQ ID NO: 26 - DNA, 21 bp, Artificial Sequence
  NaChr3_64.6M????????????
gctgctcaaactggcttatga

SEQ ID NO: 27 - DNA, 24 bp, Artificial Sequence
  NaChr3_64.6M????????????
ctaatagatgctcgtgacttgtga

SEQ ID NO: 28 - DNA, 26 bp, Artificial Sequence
  NaChr3_65.7M????????????
agcataaaggtcggaaggaagaaagc

SEQ ID NO: 29 - DNA, 25 bp, Artificial Sequence
  NaChr3_65.7M????????????
tgacggctgatgacgcatatctcta

SEQ ID NO: 30 - DNA, 22 bp, Artificial Sequence
  NaChr4_2M????????????
ttgatgacctcggtgaccactt

SEQ ID NO: 31 - DNA, 21 bp, Artificial Sequence
  NaChr4_2M????????????
ggtcgatgaacttggcgttgt

SEQ ID NO: 32 - DNA, 27 bp, Artificial Sequence
  NaChr4_8M????????????
tgacttccatattgagaagccgattga

SEQ ID NO: 33 - DNA, 26 bp, Artificial Sequence
  NaChr4_8M????????????
gagatccgtctgtacgactacctgta

SEQ ID NO: 34 - DNA, 3176886 bp, Nicotiana alata (residues 1-1,588,443 of 3,176,886)
  misc_feature (210057)..(210182): n is a, c, g, or t
  misc_feature (455653)..(455755): n is a, c, g, or t
  misc_feature (472640)..(472864): n is a, c, g, or t
  misc_feature (525206)..(526010): n is a, c, g, or t
  misc_feature (533227)..(533750): n is a, c, g, or t
  misc_feature (564531)..(564692): n is a, c, g, or t
  misc_feature (724654)..(724663): n is a, c, g, or t
  misc_feature (960902)..(961018): n is a, c, g, or t
  misc_feature (1036758)..(1036969): n is a, c, g, or t
  misc_feature (1168263)..(1169262): n is a, c, g, or t
  misc_feature (1189364)..(1190363): n is a, c, g, or t
  misc_feature (1195442)..(1195642): n is a, c, g, or t
  misc_feature (1197417)..(1198416): n is a, c, g, or t
  misc_feature (1210991)..(1212052): n is a, c, g, or t
  misc_feature (1237147)..(1237556): n is a, c, g, or t
  misc_feature (1374726)..(1374826): n is a, c, g, or t
  misc_feature (1374961)..(1374972): n is a, c, g, or t
  misc_feature (1500628)..(1500670): n is a, c, g, or t
  misc_feature (1533707)..(1536130): n is a, c, g, or t
  misc_feature (1587173)..(1590149): n is a, c, g, or t
  misc_feature (1683927)..(1684221): n is a, c, g, or t
  misc_feature (1754760)..(1754783): n is a, c, g, or t
  misc_feature (1779656)..(1779792): n is a, c, g, or t
  misc_feature (1815052)..(1815421): n is a, c, g, or t
  misc_feature (1825786)..(1825795): n is a, c, g, or t
  misc_feature (1829191)..(1829282): n is a, c, g, or t
  misc_feature (1829606)..(1829975): n is a, c, g, or t
  misc_feature (1933202)..(1933329): n is a, c, g, or t
  misc_feature (1935145)..(1935269): n is a, c, g, or t
  misc_feature (2008989)..(2009248): n is a, c, g, or t
  misc_feature (2099577)..(2099586): n is a, c, g, or t
  misc_feature (2143289)..(2143358): n is a, c, g, or t
  misc_feature (2177389)..(2177733): n is a, c, g, or t
  misc_feature (2365752)..(2366282): n is a, c, g, or t
  misc_feature (2494224)..(2494623): n is a, c, g, or t
  misc_feature (2526823)..(2526954): n is a, c, g, or t
  misc_feature (2597021)..(2598223): n is a, c, g, or t
  misc_feature (2676240)..(2676920): n is a, c, g, or t
  misc_feature (2697482)..(2697491): n is a, c, g, or t
  misc_feature (2772481)..(2772687): n is a, c, g, or t
  misc_feature (2819730)..(2819739): n is a, c, g, or t
  misc_feature (2819916)..(2822253): n is a, c, g, or t
  misc_feature (2833092)..(2833906): n is a, c, g, or t
  misc_feature (2869119)..(2869128): n is a, c, g, or t
  misc_feature (2931138)..(2931150): n is a, c, g, or t
cttagcaggcaaccagacaggcacggtacctggaggacataaaatttcagccaaccacggccgagcttcttctttcaaagctaacttctccaagtaccgtgtctcatcctcatctccgaatcccaagaaatcattgagagtcgtgccatcgaacggaagtcgcttgtctcttacttgagttgtctttgtatcccgaaccaaatggtgaacattggcgtaaaactccttcaccatgtgttcgttggcattctccaacttctccttaaagtacccccagccctcacgtgtgcggaattgggcttgcacacgagggttgtggggaagcagatcactatctatgaacctcctctcgggtatcaattttctgtccggccaccacagcctgaatttagagtaagccgtctcactgatgaatctatcaacccatgcatttgggttcttggttctgtcgatgcccccagttgctggagcaccaccatcactggtactctcttcttcccccgatagagatgctgtggggaaagtggagtactctccttctccagtttcattttcatctccggactcgtcagactggtctgagactgttctgttctctggccgcttggctaacacattctcttgctcattctctggggtcggggacacaggtaccggaaccaatagtgatccacgggaggctattgagtcagaggacacctcccgggatggaacatattcactgcctgatgtgtgagaggcagctctgtgtgcttcctttattgctttccggtttttcttcatcagttcaatctcattcggaattcgcttcactattctctggaccatctttacattgtagtccttaccctctactggttgtttatcctttccaccccgttggggttgtttgcctccgcgttttgtaaccattgtctgcaagaacagatttctggtatggttagttgaagcacaattgaaaaatcatcacactcacagaaagttacagcagaaagcagttaaggtcaggcggaccgcgcaaatgtgccatgcggtccgcactaaaacattttgtactcaggaaagaaacacgcggaccgctcagattaaacatgcggccgcacagcaattcacgcggaccgcccagattggcacgcggtccgcacagatggggtcccaatttttcatgtctctgattcttacacacgcggtccgcctgcttttgacacgcggccgctcagagattcacgcggatcgcccagaaagggatgcggtccgcttacatcaagcattatctaaattcacgcggaccgcacaaaaagttgtgcggctgcaccatggcgggactcaacaggggtcttcaggcaactcaaatcaagcataaccatggagattagcctattagttcttacttattaagcatcaggtaccaaaactaaggcatgtaaagaatctaaggccacattactctactaaaaagaaacaaaaaatcagatgaacaatctaaggctagcagtatgaagaaaactaaaataaaattctatgaactaaagaagttagaatttagacaatgggtgtgagtgttaccagagatgcacacgagaagaaggaggattagatcttggcaaaatacggtatgcacagtacacaacggctctgagtgaaattttttgtaaaagtgtaaaaggaggcgtagggggggggggtatttatagaattctgtggaccccccacttacctgacctacgcggccgcacagaagtgacatgcggtccgcgtaggtttcttctcatgcggtccgcacgtttttgacatgcggccacatcacctgacttcagagacttggcaattctaggctttttcacgcggtccgcctgcttttgacatgcggccgcgtagccttggatcagagttcagccaatttttcaactggctcaggcggaccgcacagaaatgttgtgcggccgcgtgagcactgaacagtgcctcagccacttctttttttttgcctcttttcttgcactagtttaatcctgttcctgtaacactacacaaaccattagctcaaaaatcctatcctacaaaagaaaaattgcataaacgaaaagacatgggttgcctcccaagaagcgcctgatttaacgtcgcggcacgactcaagttaccaacacaattacttcaagtgaaggagcgccaccacgtggctatcatcaatcttgcccaaatagtgcttgaccctatgcccatttacccggaacacttcgccattcttgtttttttaaggtcaaccgcaccaaagggtgtaacaccaaccacttcaaaaggaccgctccacttagatttcaactttcccggaaacagtcgtaaccgagaattgaagagaagcaccatgtcaccaatcttaaactctttcccacgggcatacttgtcatggagatatttcattctatccttgtacaaagatgaactagaataggcatggaaccggaactcatcaagctcattcaattgttcaacccgcagattcaccgcaacatcccactctaaattcaactttttcaaagcccacatcgctttatgctccaactctaccgggagatgacacgctttaccaaaaaccaaccgatatggcgacatgccaatcggagttttgaaggccgtccgataagcccacaaagcatcatccaatttcttagaccagtcggtcctattagcattaaccatcttggatagaatactctttatttcccggtttgaaacttcaacttggccacttgcctgaggatggtaaggagttgtcactttgtggttgaccccatatttggcgagcaaagagtcaaaagcccgattgcaaaagtgagagccaccatcactaattatggcacggggtgtaccaaatctagtgaaaatgctcttcttcaagaatgccaccacgctacgagcttcattatttggcaaggcaatggcctcaacccatttcgatacatagtcaaccgccaccaaaatataagtattgccacatgaactcacaaacggtcgcataaagtctattccccacacatcaaaaatgtcgacctcaagaattgtgttaaggggcatctcatctttctttgaaattcctcccgcatgttgacactcatcacatctcttcacaaaatcgccggcatctttgaacaatgaaggccaatagaacccacaactcaacactttggacgccgtccttgccccgccatgatggccaccataaggcgaagaatggcatgcctccacaatacttagttgttcttcttcgggtacacaccgacgaatcacaccatcggtgcaaattttgaaaagatacggctcatcccaatagaagtccaaggcctcccgcttgagcttcttcctttggttagaagagagctcacacgggaccacaccggtaaccaagtaatttgcaatgtccgcgaaccatggcatgtcaagcatagaaacggaaagaagttgctcatccgggaaggagtcatttatttcaagaccatccgaaggcctcccctcctcctcaagacgagacaagtggtccgccacttgattttcggtaccctttctatccactatctccaagtcgaactcttgcaaaagaagcacccatctcatcaaccgtgctttagaatcctttttagtcatcaagtaccttagggcggcgtgatcggtatgaataatcactttggcccccatgaggtacgggcgaatcttctccatagcaaaaacaatggcaagcaattccttctcggtgaccgtgtaatttctttgtgcttcattcatcgtcttgctagcatagtacaccggatggaacaacttgttgattttctggcccaagaccgcccccaccgcaacatcactagcatcgcacatgagctcaaagggcaagctccaattgggtgcggtaatgatgggggtagtcgtcaacttgtgtttcaacaactcaaatgcttccatgcacttctcatcaaaaacatattttgcatccttctccaataacttacacagcgggttcactaccttagaaaagtctttgatgaatcttcggtagaaacccgcgtgtccaaggaaacgtctcacccctttgacagagttaggaggaggaagcctcgaaatcacttcaattttagctttatcaacctcaattccattctttgaaatcttgtgacccaagacaattccttcttccaccatgaagtggcatttttcccaattgagtaccaaattagtctcttcacaccgggccaacacacgatcaaggttttgcaaacattcaccaaaagaatccccgaccacactaaaatcgtccatgaagacttccaatatgtcctccaccatttcggtgaagatagccatcatacaacgctggaaagtcgccggagcattacataacccaaatggcatccgcgagaatgcgaaagtgccataaggacatgtgaaagttctcttttcctggtcctctggggcaatgagaatctgattataacctgaatacccgtctagaaagcaatagaaagcccgacccgcaagccggtcaagcatttgatccaagaatggcaatgggaaatgatccttcctcgtgaccttgtttagctttcggtagtccatgcaaaccctccaacccgtcacagtacgagttggaatcaactcattgttatcattggtgaccaccgtcattccacctttctttggaacacattggaccagagaggtccatgaactatcggagattggatacaccacacccgcatcgagccatttgataacctctttcttgaccacctcttgcatggcctcatttagtcttctttgatgctctagagaaggtctatcatcctcctccaatatgattttgtgcatgcaaaacgtggggctaataccccaaatatcctccaaggtccatccgattgcccgcttgcgcttttgtatgaccgccaaagtggcgtcaacctgcacgttagttaagcaagcagaaagaataacaagcaaagtgaaattaggaccgaggaactcatacctgaggtgaggaggaagtggcttcaactccaacaccggtggctcctcaatggatggtttggtgggtggagttttccggttctcaagatcaagagatagcttccttggctcataagaatacgagcccataccatggagtgcattgacacactccaccctctcatgaatatcatcaacttccatatttaagatcacggcctcaagtgggtccacaacatttgccattgtgcttgtgtcatccactatcactgccgtgacaatgtcaacaaacgagcacacttcggtgctatttggttggcgcatagaattgcacacatggaaaaccaccttttcatcaccaacgcggaaagtcaattctcccgcttccacatcaaccaaggccttcccggtagcaaggaaaggccttccaagaataatgggcacctcgaagtccacctcacaatctaagatcacaaaatctgccggtaaaatgaacttgtcgaccctgacgagcacatcatcaataatccccaaaggtctctttatagatcggtccgccatttgaagcctcatggaagtcgggcgaggtttcccaattccaagagttttgaacacagaatacggcatgagattgatactagcaccaagatcacatagtgcttttgcaaaatcggcactcccaatggtacatggaattgtgaatgcaccgggatcctctaactttggtgccatggaatggacaatggaactcacttgatgcgtcattttgatggtctcacaatccatagatcgcttcttagtaaccaagtctttcatgaacttcgcataaccgggcatttgttccaatgcctccaccaagggcacattaatggtcaaactcttcatcatctcaataaactttttgaactggttatcccctttttgctttgctaatctttgaggatatggcggaggaggcctaggcaaaggtgccttggcttttggcactgatcataggctaaaaactcatgttttagtcgttgtaataacactttaattactgcattttacaaatatttgagcttaaatgattatgaattatactaaattcatgatgtatgccttgcaggaagagttttcaacttaagaattaattcgggatgaatttgaggctttgaagtctgagtaaaagctaaataaatcaagttggaatcaagttggaacccggtttagtaaaatggccataactcttagctcacaactccgttttggctccataatatattgatggaaagctctttgaaagggctacaactttcatgttttgcgttttaccgaattctcagtcagtaaaacgcgcgaacaccgcgcgatatcgcgcgtttcaaatcgctgaaacagtatgcttctcaaaaacgcgcgagcaacgcgcgacatcgcgcgttttccatccgggaatgaattattgaggggtaaaatgataaatctggagggagacactaaactaacataaagtagagctccattattgagatctagatcacattttagggagaaaaagccataaaagaaggaggaagtggaaaaagacaactcactttgaaaaagagctctattattgagtggagaaaatcagattttgaggggaataatcagatttttggtctcaaaacaaattatttaagggagagaaaaagaggagggagaagagacggttgttaaaggagaagaagaagaagactccaatcttggaagcaagattcaacaagtttttctaaactcttttctacttacttgtttatattatgtttaagacttttgttattgattgttgtattattatgagtagctaaaactcttaatattcttgggtcatggatgttagataattatgttgcttgaagcttagattgaatatattgaatttatcatatgggttgtttatttgattttgatcttaattatttgattgcttgatcaccaattgaatactatctacgaatctagagttgaactcgaaagtgggaattctagattgcatataggattgaatagagcaagttcttgaacctgggcatcggggaacggattcgcaattaagatagacatatacttaattgccttgtttggttatataataggagttgtaaatgcattcttgttaagattaataccatagacatataggtatttagttaacttgaatagaagcataaggactcgaaagattcttatgtatattgttaaccctataatcaacaatccgaatagttcaagtattcgatcttaagctaatatagtaacatgatttctaataagtccatgacccgggaatatattcatccaaattgttaacaaaatattgtgaactttgtgtagtatttctatattgaattattttacatttattgattaagttgcaaattggttagttgaacacatgtagtaatattgcataaattgataatcatgtttgagtctacatcagtcgagtagttgatcacaattcctcgtgggaacgatactttacttactactatattacttgtcgatcgcgtacacttgcgtgagtgttttggtcgcaacaggcaccaccggttccggcatatcaatgacgtgttccctagacgggttcacgacctcttgggtctcctcctcaatttcctcaacatcaattcttacctcattactcacattaggatcaacagtatcatcaacgacaaatggagctatatcttcttgcatttccccatcatcatccacaacttgattttctctagaggtttgcacatcaccacctcttccgcttcgggttgtcacggccatcacatgttggttgttatgcccacccttggggttcaccaccgtatcacttggtagtgcacccttcgggcgagtattatgagactgtgatatttgcccaagttgcacttctagattgcggatagaagtgttgtgggaggctaattgggcatccgaatcttggttcttcttcatcatttgctcgaacatgttttcaattctccccatatcattgcttgaagaactcggcccttgagattgaaatggtggcgggttgttcggttgttgatacattgggggcctttgaaagccttgcccccgattcccttggtttccaccttggttattattccacccgccattgttgccattattccaattgttgttgcctccactccaattgccttgatttccattattgttccaattgtttccttgattgttgttgttgttccaattgttgctacttccaccctaattaccctgattgccttgagggcgccattgttggttcccttgattacctctattgctttggtagttattcacatattgcacttcttcttgatcttcatacccatcattcgaataaccaccgcttccttcatcacaattatcaaagttctcttggggttgttgttgccctctattccttctcctcatcaaatttaccccttccatagcattcacttgccttgggttttgcacctgttgaagctgagctttggccaactggttcattgttgtggtaagttcggctatggcttgaccatggtcatgtaactccttgtgcaagtgtataacattaggatcaccttgaggaacattagcacggctttgccacgccgatgaagtatcggccatttcatctagaacatcacatgcttcatcataaggaagtttcatgaaattaccacctgccaactgattcactatgcactgattggttgtattgataccccgatagaaagtctgctggatcattacatcattcatatcgttgttggggcactctttcaccattgtccgaaatctctcccaaatttcatgtaaaggctccgtaggctcttgcttgaatgctagaatctcgtctctaagagccgccatgtgactaggcgagaagaacttcgcgatgaatttatccgccaactcatcccaagtggtgatggaatggttggggagtctttccaaccaatcgagcgctttccctctaagtgagaaagggaaaagcctcaatctgagtgcgtcttcagatacattcgtttgcttgctcccccaacaggtatccacaaatcccttaagatgcttgtaggcattctgatatgaggcaccagtgaagtacccgcgttgctcgagcagggtgagcataacgttggtaatttgaaagttctccgcccggattcggggaggaactattgcacttgcataaccttgattgggcaatatacgcgatgctactcttggtggtggtggtggggggtctggaatgttgttctcattagcattcactggagcatttgcatttctaccccgcctttgcggttggggcaaaacctcatcttgctctccgtcatcaacctcgtcccccaccacattaccaagaggatcttgaccatttagagccatttgtacctagatgaaatttgacaaacagaattagtaacgagaaggaaaaagaagcaagacacacaactatccaacaaataaacaaacactgtaaagctccccggcaacggcgccaaaaagtgatcgtggcagactcaatccgtagaaagagtgggctaagataactaatacccaatagtagtatcggggttgaatatccgcagggagcttcaaattggagttgtataagttgtttggcctagaagtgtgcttatgcctctaattgatcttcaaacatcttttgattgtgatttaagtactactttataatgtgatcactacttatgcaaaaactacaattatgctaaattatgactaatataaggttttataacaagataaaaaggcactagggtcgtgaaacttacctaggcggataattaatgggtatgaaattctaactcaaggatgtcaagtacggggaaatatggataaccgttgcacttttgcactcgctctcacacctctcggtagaaagagcgattttgcccaattgactctctcgagaccaattaggtatgctaatttgcctaagcaacgcaatgctcaagtaaggtattactctctcgagatttaacctattacttgggactaccattttcatgggtccatcccaaatccttgttgggttgagggtgaggcaagagattctctttttcaagaagaatcaatacccactaagcttgacttagtgtttgcaaccactaaatctaaataaaagcatactcacaacccaaatccaaacacccaactaacatccatgaattaagcttaaacacccattaattacccacactagggttgaatcacaaccctagctaatgggtttagctagacatgataatactagaaactgaagaaatagtagaagaagaagacataatattgaattaaaagagaaaactaattaattccactttgaatccacatgaaatttcccaaaatatgctaagaaatgttgctcacgagctcagctgttcttacagtgtccaaacttaacctaaaaaagtaaaatgttctatttatactacatagtaatttccggacaaaaatgccctgagggtcagatgcggaccgcgtaagagtggtgtgcggccgcctagggtgctttagtcttcactgcctttttccagctcaggtgatgcggaccgcacaagagtggagtgcggccgcgtagggtcaaagcaggcggaccgcgtagaattgatgtgcggccgctcaaggagatagactgaaatgtcaagcctctgatcattgtggcaggcggaccgggtagatttgagcgcggccgcgtgagattttgttctgaaagctggttttctgatctttagcacaggtggaccgcccagaagcgactgcggtccgcatgaagattccttcaaaatcacccttctctgattctcctccaggcggccgcatgccaaaggcaggcggaccgcgctgggtcctttccaggcggccgcatgccaaaggtgggcggaccgcactggttctttttaatctccacttttgttacctcttgttgcttggcaggtttcactccatttttgagcaaattagtggtctacatcatgtttgtgctcaaacctgcaatcaagcacatctgtaagtgtttgggactaataatagatcaaataagtgcaaagctaaggcaagaaaggggcataattcatgtacaattcacagttatcacgcgccgcagcagtgatttgaaacagtggtaacaatgacactgtatgatgtaaattgaaacagtggtaacaatgacactgtatgatgtggcttgaaacagtggcaacaatgacactgtatgatgtgacttgaaacagtggtaacaatggcactgtatgatgtaaattggtcaggtaacaatgactgaccaggacttgattgatgccacgagatggcttgatattgcgcttgggctgtaggagcccctccggagtctgtacaaacccccagtgagcgccgtcgacgataaataaatatggatggctcgggctgcacgccgcagtaggtactggaaggtaccatcatatgcattgcattgcactcatgcatttgttcctatttgtattagttgtcatgacatcctagcactcacatttcattggcttccatgctatcccttgcactgtgtacctgataccgggtgttatttgttaatggagtgctgtgcccgaggggctgactttttgtgttgacttgcactacctgttccgcattcatttgcttaactgttggaaaaggaatattttcaaaagaggttttgaactgagtgaagatattttctaaaggattttcacgttttcactgttttttcaaagggttacactgcactatatagcatgatgacttgctttacgtggtttcttgctactcagttgttatttacccttattactcactgagttggagtactcactttactccctgcacctcacgtgcagttgtaggtattgttcaccgggtagcgggttattagctaactgaaggaattactattttagctgagcaaggtgaccgccagcgttcgcggcaccggacgttgtctttaaaattccagaatttatttttgtatattattggccctgtagatgtgctcaagttttctttagatgctcgtgacttgtgtcaccccggtcgggttgtgttgggttgtaaatactggttattattgtcgttaagctgtatttatctattcatttatgtttaataattgttaaagagacgatttgggttagttgtttggccttgtcttcacgagaggctccatcacgaccgggttgggaagatgggtcgtgacaagttggtatcagagcctaggttacataggtctcacgagttatgagcaggtttagcagagtctcacggatcggtacggagacgtctgtatttatcctcgagaggctgcagaacctttaggaaaacttcgcattcttgaattcttatcgtgcgtccttgattcagcttgaaatgtaactcttgaaattccttccacgcgttcgcatgcgcgcatgagcgctcggtattagatgtgccttgatggcttgtgattccccgatcgaggggcgagatgtgatttatatgagttgatgttgggccagtctggaggacttgaggccggatctttgcctatggcttgagcaccaaggtgctgattgtgcgagctagtgttatgaactaatatgttcagttttgtccctaatagtgggaatggcggctgggtagctatgtgatgagtttgttggtactgcgtgatgttcctatatgacttggaagtgtcgaggaaggtcttctggatgatagatgaaccattaagagtttgatttccattgtgattggatgtgtagccccgagttatgggcgcgtgaagaatcttttcaagtctcctagttaggagtgaagtaaatttcctgtcgcggtttgagttcagactcaggaagactggttgactgtgtaatgtgtatgacggtggaaggcatacagaaatgttatactgaggcgaagtaggtggattatctcctgcggagtgttctgaagtggtgtgatccttgtgtgtatgttggaagatctcacgtgtaagtgaaaagtatgtgttggaaatttgagattttgggtcgcttaagagaatgggcataactgttgcgggaatgaatacgagatttgcagaagatttacagtactagatgatctatgttttcacaacttatagatgattcgagtttaatctcactaggttattgtggcataaatggagtaaaagtgttatgagttaatgagtgtatcttaatctatggtttgaagccaagtaggggagcctgttatgggcaattggttgcacggttaggtgctatgttgatttcagtttggggcgtgcgagtaaattagcaatggctagagtaaaagaaaatttcggcaaaggttatattatgtttaatggggtatgagaatcatggaatgttttgagttacggctcgtaaagaatgctcggtgcatagagcaggaagttgcttggttgtattgggacggggatttcgttcagcggtatcagtgccaatgaggcacgagtggttctgctcatggggtcaggtaaattgcagtttgaataagagtgaatgacttgcgagaatggttctagtgtgttcaagagtctccgtacttcaattgggtggtctaaagttgcatatgtggctagaaattgagtttcattggaaaatgtcaagacttgtggtatttctaggttaactaagggattctatatatcggtatcgggaaagtaaagtaaacagagctagattcgtagagagttctgctgagtaaggtgttctgggatatagtgtttctgggaatatctgagagagtatttagcggcttatgggtttcagatgatgtggtttcatgtttggggtctcgtgtggtaagcatgggttgaaggattgtagtactacagcaaagggaattatcaagttgaagacaaatcagaagaaatttaaacagatagggtagctcgataacggaccggatcagtatggtaagggtatgattaattcttggtatgtattcacggtaatgagttggcacatgtaattttgcagcaatgctcttgggttttgatgacttgcttagcgtgatttagttagaaggattcagtcatggcagcttagtttgtgcaaatgaaattgggagagttcttgttgattactaccgtggttgaagaggtgtattttctatgaatgtgggaggcatgagatatgtaaggattttcttctagatgggatcaatgaaagttcttgattagataagtagataagttacagttcagatcagaaagggaagttcataaagcacttaggcagcaggtagcctcaggtaatcaatgaaaaaggggtactgctatttgaaggtgatttgacgagagtataggtttcataaaaatggcaatgtgattaagtgatggtacttaggtggtattgcggcactgccttgttaaaccgactggtaatatttgggtttgcttggtggcacagggaaattttggagtatgtatcgtggaattattggatattgagttgtggcatgtgttcggacggcggaattgggatcaggtgttatgattcatgtgctatgtggaattggaggcggaagccctcatattcgggatatttgtgatggtggaacgtgtgtatcagcaccgtttggcgactcttgggatttggaggctcgagtgaatctttcgtggctggtatgtttgattttggatgtgatgttggagttcagactagttgtctcagtgttagcttaattctgggctattgcattatgagctgtgccggaaacgccacggattgagtggggaggtactttgggtgatgttcttgtggagtggtttatatttcaagacccagcgaatggctggggaggagtcgtcttccttattcgggctcttgtgatgggagccaatattgaggctcctcatattgattcagttctagtgttaagggacttttcggatgcgtgttccagtttgagttggctcggtattttgttgtaatgagcaaatttggctcgatatgcatctccttatgtgggatatatgtgtggatcgggtggcacgccgccacagtgtggtgttgagaatagttttccatatgctattttgtatgccttgcttcctggtttctaagaaaagtccgtattgggtgttgctcggcgaatggcgcatcggttgcgtcctttcaggatcgtatggtgtatattacttgcttcaccatggtataatgatttgtttggggttctagatatcaatcgtgtgtggttgtcaatttcaactgtggtaacttgaggtgtctcatgcggagcagtggttgggtaggatcgtgtattgtagcgaggctatgtggagatatgacatcgcgggttagatttgtgtgttccattctatgatgtgagatgggttctcagtcttgtgttgtgatagtactggcgagcttgaggtacagctctttcaattgagtcattttcgtgatcggtgtatgttccgaccgttacttatgggtgcgcgtagttacgcaagttgaggcttaggccgtattgatgtgtcatgtcaccagggtggtgtgtttggtccgaagagatcgttgggatccttaatggatacgatcggatttggtttcagcttgttgaaaggataatatcgaggttcgactcggaatctgctgtggtattagtcaaaagggaagaaatgccttcatgaatggttgatctgagaaatggttagggtctactacgtgtttcattatcactggtaggatatgaaagtgttggaatgagattttagctaataagaggtttctatcggtatttggtggttgtggatagctgttgtgaatagaaattatcgttacgagtgttggggttatgtagtatatcataggattgcacctgaggttgcagagatgagttattatagctagttcgggtttaatcagagtatagatgtgagatttcgatcttgtggatgatttcggcagtgggaacgtggttctatggtttatggactaagatggattgtggaatttcaattatattgtgctatcaaacctatatgagatagggtgacgtagaatcacccccgggtatatgcatggtaaaattattcagctattggttggcttctagaataactctgggaacgttcgaggacgaacgtgtgtttaagtgggggaggatgtaacgacccgaccggtcgttttgagcttttgcatttttatcgccagttctcgggcatgacttgccccgtgttgtgcattatttctgatatggatagttggtttcgagtttcaggaaaattggactgaatttggaagaacaatctcagttggaaactttaaatttgaaagatttgaccaagagttgacttatgagtatatgagcttgaatcagaattttcatgatttggttagctccgttaggcgatttatgacttaggagcgcgatcggaattggttttggaggtccggtgtggaatttggctcgaattggcaaagttagtattttggcggtatccggttgataggtgagattttgattcgagggtcgtaatgcaattccgagagtttcagtagcttcgttaggtgatttgggatgtgtgtgcaaaatttcagatgattcggaagtgatttggttgggtttttggtcgaatgcgagttttggaagttttggttaaacttaggctttgatttgatgaaatttgatgattttgatgttaactgtagtgttttgatgattcgagcaagtttgaataaggtattggaacatgtctgtgtttttggttgaggtcccgggagcctcggggtgttttcggatggccaacggggtgaaaattggacttgtgtgatttctgaacttttcaggctactggtattttcgcacctgcggttttgggaccgcaagtgcggtctcgcagaagcaggcattgaggcgctgaagcggaagtgggggcaaggcaggttccgcagaagcggaatcctggccgctgaagcggaatttttgccgcagaagcggtcttggatcttttaagttgaaccgcagaagcgggaatttggccgcaaaagtggtcctgcataagcggaagcgggaccgcagaagcaaaaatcgacctgggcagaagggatttttattgaatatttcatccgcgagcttgggataattccaccatttttaacgtccttgggagcttttggacgggaatttcagagtggttcaagaggaaacgacttgaggtaagaatcttggtcttacaacatgattatattgtgaaattggtctagaaattcatggaaattaagcctaagattgatgaactagggcttgagttttgatatttcaaattgggacttgataggtcatttgggctcggatttgggagttcttggtatgtatggactcgtggcgagacgaggaatccggtaatgtaagttttgtaattttttgagaagcgggcccggggctcgggttttgctagtttcgagatttttgctatttctcgattgttttcgattgggtattgttcccttagaatattgtgatgtattcgctctgaatttggatagattcgatgcgcgtggaggccgatttgaggagcaaaggcatcgcgagctagagatttcgccggttcgaggtgagtaatacttgtaaatgatatcctgagggtttgaaaccccggatttgcacatcatagtgctgtattgaggtgacttgcatgccggatatgagcgtggggtagagcaccgttggggattgtgacttggtccgtcccgattgttgattgtaatgcgtatttgactgaaactacttgttatcatcataatttgggctaattgccaagtttgggcttcgtgccaattatgtgaatcctttggggattgatattactattttagcatatcttgcatatcattttgtctcagtccaaggttttaaatactgttttgcaaactcagccatacttctaaagttttgaaaacttaaatgatattttaaagggtatttcgggctgagaactactgttttataaattcccaaggggcttataatgttttctggactgagcatggatcgggctgcgcgccgcagcagtgatttgaaaccgtggtaacaatgacactgtatgatgtgacttgaaacagtggtaacaatgacactatatgatgtggcttgaaacagtggtaacaatgacattgtatgatgtgacttgaaatagtggtaacaatggcactgtataatgtaaattggtcaggtaacaatgactgaccaggacttgattgatgccacgagatggcttgatattgcgcttgggctgtaggagcccctccggagtctgtacacacccccagtgagcgtcgtcgacgataaataaatatggatggctcggattgcacgccgcagtgggtactggaaggtaccatcatatgtattgcattgcactcatgcatttgttcctatttgtattagttgtcatgacatcccagcactcgcatttcattggcttccatgctatcccttgcattgtgtacctgataccgggtgttatttgttaatggagtgttgtgcccgaggggctgactttttatgttgacttgcactacctgttccgcatttatttgcttaactgttggaaaaggaatatttttaaaagatgttttgaactgagtcaagatattttctaaaggattttcacgttttcattgttttctcaaagggttacactgcactatatagcatgatgacttgctttacgtggtttcttgctactcagttattatttacccttattactcactgagttggagtactcactttactccctgcacctcgcgtgcagttgcaggtattgttcacccggtagcgggctattagctgactgaaggaattactattgtagctgagcaaggtgactgccagcgttcgcggcaccggacgttgtctttaaaattccagaatttttttttgtatattattggccctgtagatgtgctcaggttttcagaaacctcgcactcttacgagtctaaccatataaaatttacccaaaatggaggtcaaatgctcactcaaaaacccaattgattatactaagaactttaacccatttcctccatttttggacctcaacttgaatttaaaagatggattaagcaattagatgatagattaaagctagaaatgatcaaagaaacgttacccaataatctcctcttcaaaatcctccaaaaatcaccttggtccgagttagaatttgagtttttaacttatgaaattaaaccctcggataaaacccatatctactgcgatttccgcttaagcgactccagggacctcttctgcggtcccgcttacgcggtcccataaccgcttatgcaggtttcctttaaaatcccagcggccgcttctgcggctagctgaccgcttaagcggtcaccgcctaagcgaccatcaaaccgcttctgcggtcaagatccgctcctgcgaccaaaatccgcttaagcggactccgcttgtgcgaccatttttccgcgaaagcggaaacagcagaagtctgctgcaatatttccttcaacttccaaacttaatccgttgaacatccgaaacacacccgaggccctcgggacctcaaccaaacatacaaccatatcccataacatcatttggacttgtaccaatccttaaactacctaaaacaacgccggaaacacgaattaatcattgagttgaacctaaaatttccaaaacttaaccaaaatcataaccgatgccgaaactaaccaaacgaggtccgaatgacttgaaaatttgcacacacgtccaaattcacctaacgaagctactgccgctctcggaattccatttcgagcctcggatcaaattctcgcctatcaaccggatacttcaagtttccaactttcggtatttctaggctaattgagctacggacatccaaaatacaatccgggcacgctcccaaccccgaaaccacctaacggagctaacggaaccatcggatttccattccgaggtcgtcttgacactgttccgacaacggaccactttccaacacttagactctcatttaaggactatttgtccaaaaacactccgaattcaattaccgaacatcccggcaattcaaaatagcttaaatagacttaggggaagcagtaaacgggggtacggggtgcaatttctaaaaatgaccggtcgggccgttacagctaatacgagttttcctcagaaaatgggaaacagaacacataaaagcaaatagggggaactgtactgaacatcacactgtcgcggcgcgcaacccgatcaattcagcataaccatggcagcgtgccacccgatccacacaatataaccatggcggcgtgccacccgatccaaatataggactcacataaggagatatacatcgagctaaatagctcatcacacccaaataccgaatatcggtcataaacactctaaggtgcataatttcatccctaagggaacatatagcgctataggctacaaaactcgagcataacggaggtgcgatacatgatctaaatctcaagagccatcctgctcataagacatcaccgctgagcggaatctcaacacttaggaaaatttaccaagccgtctcacaactcatacggcgcaatatatctttacatgaattagctggccacaaaataacatcgtggttactctcccataaatagcgcattgctgaaatgaatacaactggactgacatagagcccgtatttgcattaaatccatccaccgacctcaagtcaatcctgatcgtggcaaactaggccaataacctttcaaaggtccatgctaacttccctcttctcataacacacaagaacatcaatcttaactggagcaaacctccacagtccataaatcaataaacagagtgcccaccaggcataaattctcacatcgatgatattaccaaaatcctcatacttggtttaaatttctaatcaatcaagtgactacatgtcacacttatacaatcttactgtggaacaagctcccacaatcttccaaaataattaacgggtctgcacattcaaaccaccgactgctctaacgctgaaaagcgatcaagaatccttaaccaggatgcgaagcctttctcacaaaacaccgatctcaggtgatactggcaacaataccaatttacccaaaacactgcaactccttccaagctcatcaaagctcatgacatcatagtcattaccaaactacaaccttggtccttactttagattttgtaccaatcactgcacctcacgtgccgatatacggcagacacgatttccatcacaactctggaaccgccgatagactaacactttatcatataaaacttttcatttccgctcgcttcaggagaactatagcgacatacaggcgaattctcataaccgacgaatatgccaatctctaaataggggttcaaaccaccataacccttccggggtccgcctactcataacaggccatgacagaagaatgcttctgaataaaatcaattacggcggccgacaagcctcacacgtaccgccacaaatcacttacataactcgatcacgctgaaagagctgatcactgacactaatatgccaattccactatggcttaataaatctacttccttccaatttattctggattgccttaaaaataatacttattcattcaacacataacatactccatctgcactcattccgagtgacttcgaatcacgagaccatgctgtctcaaatcccacgaaccattttagaactctcaaatgctacaccgcaagccaaaatatcatagaacattttgggcaccttctcataagctgctacaaagcttgactcttatatgtacctataaggtcgacatcattaggcaccacactttaccctttgaattcacgaggaccgttactgagagctacccgctctgacttggtcccaaatgcaaccaactccaccaaatttcataacatatgaataccctctcgatgaagcacccagcgggatcacttccctcgaagcctgcacctatacgaggcataaatcatgaatcttccctcaagtatgaacatgagccaataaggctaaccatagcatgcattcaacaattcatttgctcaaattaccactcatggccctttttcgtagctgccataacccgtcaatatgctaataaccagaaatcacgcaggtaattaaccatgcaacccaatcgtaagcggtgggactcccccacttagctcgaagccactattacccaactcttgaattcaccagaatccttcatctttcattgacataaccttgtgcaatcaaccgccaaaatttttgaaatcactcagaatcatcaaccacattcgcacggccgatcacttcgttgaataaccaatagaattcattgcagaagcttcaccaaccacgcgaccgcgaacctgctcacaaggaataacccacccgtagaagccacttcctgacatcctttaacactgttgcacggggtacaatcactacgacatcaataacccatcctgggtccaggctcaccctctggctgcaccagtccatatacccctcgtggacatcaattaatcgtgcggcaatgtccttccaatttaaagttatgctgcattttccttcattttaagcagctcccttccgctatacccaatcttctgccgcataatggcccatgcttcaagttagctccgtaggccccaaattactaatctctgaaattctcaaatcattccaaactctccttaaggtgtgtagtcatcctactaccaagcccatatgcagcacccggcattctcccactttggcggaactcatccctttgatcgaccattcggccttgctcctcgcacttggccttctagaagttttaaacaccgtctaacacttcccacatgtccttcttcatactttgctgttcaattgttgccttagataaaatctatcttcatagcacttgaaccaacaagtcgctattaactttaaatgtttccgaagttcatcttccctgagtcatcaacattagggatgccgattccatcctgaacccccgcatcccgcgatctctgactgtcgcttcttcattattaactcgcaatatcctgccccaaaggcgaatagaagaaaacaataacactggcaatcttaacacatacaatcgaggacgacgataccacaccgccaatggagaccacatcatacttgaaaacaccaagtctcatcatctcatcatctcaacctgaacatcctcagcctgattacctttccccctgccgggaataaaatgttgaatctctaggttacgaaccgagtcaacctcccttcaagtccttcactgcctccacacgtaggtaaacatcctgccaacatatcagtaccgcaaagaatcattcataagcatcatggcaacttgtgcctatcttcaaggctctcagagtaccgctgttgagccgaaataacaagatatccttccatagggcgactataatagtccattcagccataccgggagaaacatcccgcaccacatcggtgatgccatcaaaattcttcaattctcaatttataacaagcgcttcgcatcgcataagaatgagtaagaaggaaacaaaggcataagccttagagaaatcaaatcgcacgataaggaaatcaagaaggtaagcactcctaacagccctgcagcctcccgaggataagtacagacatctccgtaccgatccgcgagactctactagacttgctcatgactcgtgagaccactgggaacctagagctctgataccatgttgtcacgaaccaaaagccactaagggtcgtggtggcgccggacaccgctgtcaggtaagccaaccaatttacttgaacaaaatctcatttttaacattttggaaatacatgatttttcttctacgtttagaaattttaaagaataaagtttcaatcaaacttaaaagttaaacaataattacaatacctcaaaccctcccagaacccggagtcacaagtgcatgagcatctactggtgggagaaataaaaataccaatcttcgtctgaaatacagtggacgaaaagtaaatacagtactggagagggactaccctagctgtggccgtctcaaatgatgcagctcctctagtcccagaatcatccgctccgataggtctagaagaccactggagtcacatgtacctgtgcaacaaaatgcacagcaagtgtagtatgagtacgtaaatcaacgtgtattcagtgagtgtcctgcctaatcccgaaagggtagagacgagatggtcaactttgacactcactagtagtccaatgactatttatcattttataagtatactaaacagtggattcgtataataaatatgtttctaatccaaatagaggaaaacaagtaatcatataattcttttcatggataagttccttagatttcttgttattattaacaatacgatctcgagccataataaggcatgtaacaaactcaaataagtccaggcagcaacacaagcatgcgcaaatcacaccgaggggacggcccgatccaacagaaatgtaaattgtgcactgccgagggtcgaacggctcgaaccaatagatgcatctattttccccgctcgcgaatcatccatgcgacgcggtaacctgctcgcgaatcatccatacgacgcagtcaacataaagtaaacaaataccctgctcgcgaatcatccatgcgatgcaggtacacacagaatacatgctcaaacagtcaattaagaatttttggaaattattcatcaaataagaatcaatcctcttttaacaatttaagaaaaatgaagtttaatcctttttgaaattcagttactagttcaatttgatttaagcaattcgaatgccaataaggtttcaaacattccaagtaagcatgcttttgggtcctaaactacccggacaatagcatactagtagctacgcacggactctcgtcacctcgtgcgtacgtagcccccacaaataggagcacataatcaatttaacttacctatgggggtaaattccccctcacaagattagaaaggagactcacctctctccgaagcgttctttcaacaacaagaataggctccaacctcaaatcgaagccgaacgagcaccaactagttaaataaagcaagaactagtcaataagtgctcacaaagttgaattccaactaattaaatagttttccaacctttcctgcaagttttctaatttccgaccccgggcccacgtgcccggattccgagatttttcgaaggaaaatactctccataacctaaggattactaatatgtgaattttagttcattacaacgctaattaggtggttaaatcataattttaccaaaaccctaggtctagctctaacctttgattttatttgattattagtgttaaatctatgtcatgttcatgtatttaagctaagagtgagtgggaattacttaccttgtgatgtgtgtgaaaacttctctttgaaagccccaaaatcgcccaagagatgagtgaaatatgagagaaaaggggttggagttcatcttaaattaactcactgcccccagcgatttccgcttatgcggaaatatggccgcacctgcggagcccgcttttgcggtaaaataaccgcttatgcggttttggggaggcctggctagaccgcttctgcggtcgctgggttcacatatgcgagaccgcttctgcggtcccagagccgcttatgcggtccctccccctccttggctttccacttctgcgaccaggtggccgcttatgcagtcaccgcttctgcggtcaaggagccgcagaagcggttttgacagaagcagcaaacttgcttctttccaaaatccaacttcgctcaaacctcaaccattagacgctcggggctcccgagccctgtccgaacataccgacaagtctgaaatcacgaggcggacctagtcgaaccctcgaaattctcaaaacaacgttaaatcaaggaatcgaaccccaaaaccaattgatcaaacttaatgaactcaagttcttaatttcctttcaacgggtcaaaacgcccttaaactattcggattgacaccaaattttacgggtaggtcttaactgatatttcggacttgtaccaagtttcggaaccggaatccaaactcgatacctaggtttttaatgaatacttagattctttaattctttagaacttcgatttaacaattttacataaaaattcattactcgggctagggacctcggaattccgttccgagcatacgcccaggtcccatattttcccacggaccttccgggatagtcaaataacgaatctggatccgtttcccaagaaagttgaccgaagtcaaacttggccttttaagaaattcttaaggaaataattggtttcattttcactcaaaacttttctaacttccgaactaatcgcccccgcaagccataattaagctaaggaaaacgcaagaagttttatttaagggaacgagattctaaacagtaaaacgaccaatcgggtcgttacatcaatatacctgaaatgaagctgctcatgccctcagactgctgaatgacgcgacggagctcaaaatgaccggtcgggtcgttacagactttccgacggagtctctcgatacttttgaattttttaatttctaatttttttaaaaaggaaccgacggacttccgtcggtacataatgatattttgaccggtcaaaatttaaatggttgtaccgacggactccctcggaacattttgtatttatattttcgaattatttttttagggtgtctgtcgtcgctttaaaaaaataaatgaaaaagaaaataaagttatccacgtactcaatcgctattgcatttacataatattttgaattttgttctgatagtaccgatggacttccgtcggtaatttaaatatataatcttatgtgtaattattttttattttttattacacagtaccgagggaagccgtcggtaagtccctcggtaagtatttacttaattatcttggtggttgattagcctatttattgaaatttacactaagtgaaggtaattaccctacttaaaaatatagtagtggtaattagcttagtaatttataattacacaaagtaaaagtgaatttgtagtatccttaactacatcgattaacctatacattaataattacacactaagaagaattgtattatgtagttgtttccatatgaaatattagtgatgatttatcttataaattgatcattactataagtagaagtgtattaatggtgtctttaagtaacgttaatattttattatcatacacattgataatatactaagcaaaagtgtattagttgtatttagcttgtagactgatagttacacgaaatataagtgtattaataatatacctataagtaatgttggtgattgattagcctatatacattgataattatattacattgataatagcactaagtattagttaactagtggcatccttagtttgtattgtaatattctactggcaggtggtacaacaaaaaataggcactgcttgccaaaaatgtaccagatttaccgacggacttaccgacagagtccatcggaacaattattcattttcaatccaaaattttttaattagcgagggagtccgtcggtatgcttgaaccaaattttcaaattttattgaaaatacagacggatagcaatcgaaaaatgaatttattcatatttttaatttttattttactaaattattatttttaatttaccgacggatctccgtcggtatagatatttttattattatattattttataatataccgacggatatccgtcggtacgtaaaattatttgaccaactgtcgtcagaaatgtaccgatggcattccgatggggtccgtcggtatatattaccgatgaaggatttacctaccaaccacttaccgacggatatccatcggtaaagcctggttaccgacgaaaatccatcggtaacctgcgtcggtaaacaggtgatttttagtagtgtcaatccatgtatagctaattatcatattattatcacaaattgaatgtaggacaaaataatataatgattcttgttcaaaataatacatatatttgtgtgagaaattcaaaaatagccagatttacaactggtcgtttaaaaatagctcaatttcaaaagtaatcaaaatttagacactttttatgtaaagataaatctgagcgaaaatactgttcaaaacccggaaaatacgcccgtctattatgctggagttccagcataagtatacttgaactcccgcatattatactggagttcaagtatacttatgttggaactccagcataatatactggagttctagcaagtataccggtccagcataatatactggagtttggagcactggtgctccactctcccgtatattatacgggaattaacaaagtataccggtcccgcataatatgctggagttcatacataggtgcaccgaactcccgtatattatgctgaaccgatctctgttgcaacaaaatagtggctaatttttattgacttggtaaacactgactatttttgattgaccagtgcgaaaactggctataccattctatttttactatatttgttggatcacaagttgtgcagcaacccaatccactatcaaggaagcccaatagagttgaaatggcccaaacaaaacctctctgacacgcatttgtattgacctattgtaacttaataagacccgctcaaattattgtaattaggggatctgattcattttgtacaaacaagatttggtaaaaacaagatttaaccacgaaatttgttaggaaatagagcaaaaatcatatattcttgatccttaggttatgggtaaatattctcttcaaaaatttccggaatctggtcacatgggcccggggatgaattttaggaaccttgtgtcacacctcctttttcactacacccgcatgggcataaaggagtttttccattttaagtgacaatcggaacgggattatttatttcagagtcgccacttgggaaaggtttggcttttggtgtcccaagtcaccggtttttcttgaatcccgaaccgaggaaaatttcgactcccaattggagtctgcgaaccagagatcctgaataaggaattctgttgacccgagggaaggtgttaggcaccctcggatcccgtggttctagcacggtcgcttaaatcattgtatttggttaaaacctgattttaaaacatgctatttgtgctttttatttatacctcttttcatctttatttattttttaaaagacttgcgatgtcgtgaaaacgcgtctcgaaccacggcaaaatcaatgagcccgtgattgtcgacacgcttcgacttcatcgagatttgaatttgggttacaatcagtgcacacccgaatttaggaaggtaatttgattaaaacgcgtctaaatgttctatcgcaatattactttggggaaggtcgtgaaattcgctaaacggccctcccgtgttctaaattaattaccgtaattattcatcgagggccccacatttattttttgtttgggcgtggctcatctcgaaattatttaaagaagtagtttagaaatgactaggagtttttgttgttgtaatgtctaaagaagctaaattcaacggtgattaataggagagggttagaatatcattgcaatgacagtcagaaaggtcaaggggtcgagcccccaatgatgacctcccaaagatgcatataaacccccacccaaaacccaattggccagaagcccatgtatcttccatagaagaattacagggtcgatccccagtgctgcataacaacgaaataaactccatgaattcacagtttgacttccaatcgatttctactaaaagttgctgacagggattcggatatttgaccacatgcctttttaaacttctattcatgaattaaaattacaccaccattttttaaacaagccaacctccaaatttgtttggtacggtcaaacaatctgacatgcttcaaaattgcattaaaattaatacaaactcagatttctttcacagttcaatcatacaagccaattaataaaatgagcaattacaactatctatatccaaatgagcaaaagatcgccaatatgattgtatttcagcctcaaacagttatcacaatcagtgggacttcgaagagtacctgagatttgaaaaatgtaggaagaaaaggattgaatcagcaactataatcacagcagcaagaccaaccgtaacaaatgagaaatcacagcccaggagtgtttaaatcagtcaaacaaatgcttgaaatcagcaggaacttgaagacccaaaaacagaaatcacaagccaaccaaattgaacccaaatcaactccaaatagccccaaaacactgtaaggcaagacttctaaagagaaatctagaaaaaatactgtctgaaatcaatgaaatagtaacatttttgtagtttttcgcttttgtatcttttttttgtcttgttttttgtatatcaagctaatctgaaactaatttttgaaatgaaagagaacttcaaagctgaataaaaaaagcagtatgttttctggaatctttctcatggaaggaacctcttcaaagacgccttaagagtgccttttataagctagaacgagggcagccctcaaattcttaattactctaaaagtccctgacttatctcatttttaaaccctcattttctgacttgttctacaagttactgccctaagtctttgaaaactacactaaagccctactctagaaggtcctaggacactctttaagtgagacaaaaccccaaactacccttgccttattttaaaattacaaattctaaagattctatccctaaaaagcccttgaaacctccctaatattactgactacaccacaaccttactccaatctcagaccttagtaaaaagaacttaactgcggttaaacctagaactaatttccttcagctaaccaattcaatctatttacaaagaactaattaacactaacaaggattaatgctaacctgaagagaaattgctaattaaaatacctctaaacactgcgattatctagaataaacttgacgactgattaattaattaacactacgattaccagaaattaaactaaatagctaagacgattaaaagaaactcggatcgaaagaggagaaaaggagcagtcaccattcaaaaaacatcaaaactgaaactcaacataatctaactagcaaaacttaactaataatgattatgagatgacgagaaataaagagatgaatcagaacttattaatcaacacgaaacaaaagattgggcatcacaggaaagaaattaactaaatcgataattatctattcgaaatgagtaccagaaacagaagaagaagaagaacaaagacaaacaacgaaaaagaaaagcgaaacgggaaaaacttaccctcgaacctctgcccggaaacgaactcgccggaatcggggtccggttaatgttgttggtccatttaattcaaaatggactaacaactttaactagaaaccggttcggctccaaagtcttcaaaccggtctcaaactgacgaaccctagatttgaaatttgtgaatttccaatcagattaggaaagttttggttgaggatttaggctgagggggttgaggagactgcctggtgcgattttggtcgaatttggaagagatgagactttgagccggaacttcaaactgatattcgaagggctcggaacggatttgatggaaattaacaccgaatatggaaagcgggggacaaagagaggctggggtgtaattttgggggcgaacagaggtggcgccgccacccatggaggtggagcatttggtggcggctcagattagggtttctgagggggaggtggacgagagagacgatgaggggggtatggggaggggttcggacagtcatataccaaatagaccccacttcctgaccgttcgatcatctaatcctagacggtccagattgcactccaataaaacgtcgtcgtttcgggggtcaggggattggaccgggtctggaggttgtttgggctggattggacaagtggaaatgggctgcaaattggcccaacaatgcccttttattataagcctctttcttattttttaattgtttttctcttcttttttttccttttgtttgttctttttcattttataatttttacactttttctgatttataaaaattgcagaaattaaaataaaaattaaactaaactaattaatacctaaattaccttaaaactattttgcgataatttcacaattaaaacaaataaactgcaaaagtgaactatttttgagatttttcatattttgttctaaaacaaattaacccgtaattaatcctaatgtatgaaattagatcctaaatgcaaatgcatatttttgtattttatatgaattaaaatgcacaaataaaatgcaaacaattaacagaaaattcacataatcgtaaaaacaaggaaaaatctttttgtttgaattttatgggaattattcatatatagggcaaaaatcacgtgctcacagctgcccctctttgctcggaaacataaaaggttttcgggcaaagataagtgagcaaatacgagcgatttttgcccgttcaaatattccgttgtgaagcattttgaaaagttttgaccgcaccctgcttcagaggttgcctacatatcctgggctaaacaggaatcaggtcagtgtagttcgggagtgtctggtagctgggactaccaggagctgtgatttcgctgcgattgctgctgctactgctcgctgaccttccttattacatcatgtcaaaataaaagaagctagcctaagctatgaactatgaattacaaaagtcctatctaaaatcttcaaacttgcatcttgtacttccttgttgtcttgttatcttgtgtttccttcaacttgctaactgagatgttgttccttctctccacattgctgaacttgaataaacttgaactggaatgtattcctctattatccaggcgggctcctgacttcacaaaaataaacaaaacaaagaaaactttctgccccagtttgaaaaactgggtgcttgttaccatatattatcaaaaattgaaaactacaacttgacttgtgataagactgaaatgtaactataaaatttaaagactgaaatgtattcctctgttatccaggcgggctcctgacctcgaaacttgaaaactaaagactgagatgtttcaaaacttcaaatttaaagactgaaatgtattcctctgttatccaggcgggctcctgacctcaaaacttaaaaatttaaaagactgagatgtttcaaaacttcaattttaaagactgacatgtatttcaaacttaaaatttaaaatttatcttaggtgaacatttcctcagactaggattttgactctaggagataattcatcagactaggtctatttttgtgtgatctcaggagataattcgtcggactgagattttgactctaggagatattcatcagactaggtccatttttgcgcgatctcatgagatattcatcggactgagattttgactctaggagatattcatcagactaggtcctttttgcgcgatctcaggagatattcatcggactgagattttgactctaggagatattcatcagactaggtccatttttgcgcgatctcaggagatattcatcggactgagattttgactctaggagatattcatcagactaggtcctttttgcgcgatctccggagatattcatcggactgagattttgactctaggagatattcatcagactaggtccatttttgcgtgatctcaggagatatttatcggactgagattttgactctaggagatattcatcagactaggtccatttgaattcaaacattcctttccttctttttcaaattgtgccttcctttctttttcccgaattatgcctttctttctttttccccaaattatgccttcctttgtttctctaacttctgcctttcttttaccaaattatgcctttctttccttttctaacttctgcctttcttcccaaattatgccttcttttctttttctaacttctgccttccttcccaaattatgccttcttttcttttcccaacttctgcctttatcttaggtgaaagattcatcagactaagattttcatcttaggtgaaaagttcatcggactaagattttctaccttcatcttaggcgaaagattcatcagactaagatttctgtatcttaggtgaaaatttcatcagactaagattttcttccttcatcttaggtgaaagattcatcagactaagatttctctatcttaggtgaaaatttcatcagactaagatttttatctaaccattttcctccgaaacttgttttatctaccttctaactctaattaccttccttcaaaactacttccctaaaaactggtgttgcattcctccgaaaactgatgtttctctcctgaaaactacttccccctttttttaacttgtattgaccttcatgttcttcatatgtgtacccaacttcaaaacgattttcaaaacggcggcaaattttctgccccagaatattttccagccatcaataacattttcatgcccctgtttcaaatcaaagcaaaatttgtcagtttaaagcgtggtggctggttgtggtacttccgctggagatggctttcctttttctcctttccatgctctgcgttgtccgaccatctttggaactaggctgataacttccgaccttcttggcgaccccttattcacaaatttccactttttacccttcctattggttgtgaaccctaaagcacgtttgttgcccccacaggatgttgttctttcttggattatctgatggccttggccctaaggtttgttgctcccttacttgccatgatatcgttcttttcgtttgaagaccccacttgtttcttgcctaaacacttcatttgtcgtccttggcatcaaacatacctcttctgcattcaaaccctatacattctgtttgttgccctgcctctgaagtctgaactgccttttaccaaccctcgtgccttatgtaaaccccaaagcatgtcgatttccgcctcattgtatgttgttcttccaaattgaagcccttggcccctaaccttgaaatttattgctcttccgcctgactcttgtcacagaaaatatccattattcgatcaaacccactacactttatctattgcattgctcatgacctgatatctaccaaacctttgtgtttcaacaggatcccccagcgcctgttgattattaccagctcagtgctcttgttgcttttcttgacttgtgacattttgatatgctagccaaaccccatctgtgcaattggcaagctggtggcaaattttgaagtcatttctcacttgttttgaccaaacagactcaggaaaaggaagtaaacagaacagtggaacggaatgaaggaaaaagaaaagaaatgaatcctaaagataaaactatgaagtagaaacctatctaatgtgtaccaactctaatgaccatgacatgcacctgtagatattctgccaatcgaacctgatgttcagctcttgttgtaccttttcgccgtgaaactgggcttcaatgctccgcttatccgatctgattctcatttcttattcgacttgtagtgcccgaagggttttcaccatcaagcctctctcattttgttcttttctcaacttaccatcgcctcaaggtgcccatgagggttttcaccaataagactctctcatttttcttttctctcaacttcatcaccttgcggtacctgtgaaggttctcatcaataagattttttcattcctcatttatctttcctgcttggaccggagagtttcccctaacatgaattaccatcagctgcttgacctagcatttctcgtagactgatcggaaggtctttgtttggaccgtaatgtgggcttttggatagggttagaaagaaagggtataaaggctcaaaaacaattcagaatggggttaaaaactacaactttcaaaatcaaatctttcacaacaatcacaacttctgccccagtttcttgcttggggacttttggaattttattttggtatgactgaacctcggagaggctgcctacgtacctttttgggatcaagtcaaacgtagttcacgttatcataattacttctgttgtgactctttcttttcttttcttttgttttctttcttttcattttcctttcttttcttcttttcattttcttttcctttcttttcttttctttttccatttcttttctttttctgttctttttccttttttttatgttcggcacctgcatttcttgattgtgccgttaattccgaaagaggggtacgaaagaaaataaacatggctcaaaaagggtgacaatggaaaacagtgtttggatagcagaacaaaacgccttcgtcatttcaatcctccagatatgccagatgcaaaccaatacgattaatgcacagaaattacacatagtatctcttgaccgcctcggagtggatggccattttcacacattttcctgctacatctatcaaatataatgcaccattgggcaacacttactcttattaccacgagcggccctctgtcaatttggccaactgtcctcagggttattctatctgccccagtttcacatggttcgggcgtcaaacaatctcaaaacgtccacatctgttattatttcctcaagtgcccctattgttttcaaaatggtttcattgtttctcggctaacgtagcccttaaagatcaaactgagaattatgcgtgcatgtcatgtcactagaaccagcaaaagacaaaacaaaaggatagaaacggactaaacaaagaaaatgattgggagtaacagaagattggaattcgcattagacaaacgatgaaacagtacaaacaacaaaacaaaacaaactgactggagtacaaccctagaatgaaaatgaaacaaacctagacaacactaaacaaatcattacgagtaaacaaactagacaaaatgaaaggataagagggtttgatcacaagacaatatccggattacaaccctgcaaataacccggacaacagaaatgacaacagaatgaactaccagagcccctccctggctgacttaggaatggagcgtctttccaattaccaagtacggtatcttagccactaagcttcgcatccatattgccatgaccactatctgcttcagtatcttcgacttcagtccacatgttcccaagaggattctcataccctatgtctccgggcatcatccccacaaagcgtgtctcctcatgtaaaggatgtagcgtgatattctgggtgccactgttttgaatcaaattcccctggatcatcctttctatttcccttttcaaatcccgacaatcttccacattgtgccccagagcattggagtggtattcacacttttagatgagtcaaagcttctcgcacgtcggtccacctgatttggaggaatgggtgcaatcatgtcatgttgtttcaacttctcaaataagcttgcataggactctcctattggtgtaaagctatctttcaacttttgttcccttctatacccctggcttggatgtgggttataagctacttaaaaattttgcggaggctggcggagattttgtgatactcgtgttcgctttcttgcgcgatttgatggctggacaacataccggggtggatcaacagagtatggtgggttctgaggtggatagtaatactgatgaggctgcacatgccttcgaggcgttctcctaggacctcttcttgaccctgatatcatcatgatttcttcatccctttcattcgtgttgctagcttcaatttggacagcctgagctgcagctttgagagctatttgacttataattctgcctgtcttaagaccgttctccaccatttctcccactttgattgcttccgggaaggatttacccactgcggacgctatgtattgataataatccggctcttgagcctgtagaaagacagtgattaactcgtggtcatccatgggtgtcttagctctagcttcctgctctctccatttgatggcatattccttgaaaatttcagttggtttctttttcaggttagaaagggaaatgcggtctggggcaatgtcgatgttgtactgaaactgtttgacaaaggcccgtgccatgtcatcccagacgtgccagcaagatgtgtcttggtccaaaaaccattcagatgctactcccgtaaggctttccccaaaataagctataagcaattcttcatttcttcccacatccctcaattggttgcaatactttttcacatgggctatggggtctccatgtccattgtacttctcaaatttgggaagcttgaaaccaggcggcaagtggacatcggggaacatgcatagatctctgaaggcaacactcttttgacctgccattgcttgcgtgtttttcaaccgttgttctaatcttttcactccttgggttatttcttcctgcaccctctttcgggcctgagcctcctgagcacttgtaacagcttcaacgtcggttatcattttttctcagatcttgtgtctctagcctaccacaaccaaccacctcaactttctaaacaattcaaaacaaaacatgttagactggattgagtcggtcctcattattcacatttttttcatttttcttcaattttctcttccatttttcatttttttttctttttttattttttgttgtggtcgaatcctatgtggattgcctacgtatcgcgaccccgcacgaatcagaccaggcgtagttcgtgaaaataaaaggtaaacaacaataaaacattttttggaatttttcattttcatgataaaaacaaaactaacaaattccttcccctactcgccaatttcaaccaaatggctgtttttgcaaacatggccccttctcaattttacatgaattttgaggctgggccggattattttaaccaaaaaccgaacggtattcacttaaccactgactctttttcttgtttttcagattaaaataaaagacctaattttgcaaacacggcctttcagcacctcgggggcgaagattttaaggctgcgttagctaaccggtcaaaaattaaaattgaccacaatggccgttttgcaaagtcagccttccggcgtccctttcaggaacattcggctatttatgacaaaacggcattattcgacttatttacgactctttttttgcttttcaaaataaaataccccgtattacaaacacggccttttaacgcctcgaggacgaagattttaaggctgtgagggtcaaaaattaaaatatgaccaaaggtggctgtttatgcaaagtcagccttccggcgtcccgcttgggaacattcagctatttttgcgaaaacggcatcacccaacttatttataattcttttcttattttttttcaaattaaaataaatgacccggtattgcaaacacggcctttcagcgcctcgggacgaagattttaaggctgtgagggtcacaaatcaaaacatgaccaaaggtggctgtttatgcaaagttagccttccggcgtctcgtttgggaacattcggctatttttgcaaaaatagcatcactcgacttctacgactctttttatattttcaaattttaaaaataaataacctgatattgcaaacacggcctttcgtcgcctcgaggacgaaaaatttaaggctgtgagggtcaacaatcaaaacatagccaaaggtggccatttatgcaaggccagccttccggcgtcccgtttgggaacattcggctatttttgcaaaacggcgtcacctaacttattcatgacacagataaatttttttgacatttttactattttttgcaaaggggaggttggacccgatgagggttgcctacgtatctcacgccctgtgagaatcaaacctgcgtagttcgggcaaataaactaactacaatttttaaaacaaaactttttccaagcttttcttcattttctattttttttaaatcaaatcaaaatgaccatttttttctatttttcaaacaattttcccaaaataaaagactctttttttttctattttgcttttgcttttaataaaacaaactacataaaaaaatattttcttttttttcattttcaaaatttcggcagagtttcggcagtacttgggcatcggattttatcccaatattaactccctaactgctatttctctcattttctcttttttgtcttttctcaaattccgacattccaagatttcaaaaaccggtcaacatgcgggtccgaaacaaataaatgcacggaaaacaaataggatgcatcaggatggtctttttcatttcaggttgctagtcctagacggacccaacccctgtgttgagtcccctaagtcaaatgcaacatgatgcaaataaacgttcctactagggatccggcatgaagtcaagttattctatgttcaaaacctgggtcgatgttctagactgtgtacccgagcggacaactcgagtcgaggagggggcaactttccgggaaccaacgggttggccggctttatttcagggtatgacactaacagaatagggagtctcaaccagtaagcacatccccggaggtagagagagaagggtatcggcacagtttatatatagttcaaataataacaaagcggtaacaattagcacattcagcacaaagcatgtaggaaaatcagatataacaaaatacaacaatttatctaagctcgaattctgaaccctgaacaaaaagttctgggctcttatccccagcagagtcgccagagctgtcacacctcctttttcactacacccgcatgggcataaaggagtttttccattttaagtgacaatcggaacgggattatttatttcagagtcgccacttgggaaaggtttggcttttggtgtcccaagtcaccggtttttcttgaatcccgaaccgaggaaaatttcgactcccaattggagtctgcgaaacagagatcctgaataaggaattctgttgacccgagggaaggtgttagtcaccctcggatcccgtggttctagcacggtcgcttaattcatttaattcattgtatttggttaaaacctgattttaaaacatgctatttgtgctttttatttataccgcttttcatctttatttattttttaaaagacttgcgatgtcgtaaaaacgcgtctcgaaccacgacaaaatcaatgagcccgtgattgtcgacacgcttcgacttcatcgagatttggatttgggttacaaccagtgcacacccgaatttaggaaggtaatttgattaaaacgcatctaaatgttctatcgcaatattactttggggaaggtcgtgaaattcgctaaacggccctcccgtgttctaaattaattaccgtaattattcatcgaaggccccgcatttgttttttgtttgggcgtggctcatctcgaaattatttaaagaagtagtttagaaatgactaggagtttttgttgttgtaatgtctaaagcagctaaatgcaacggtgattaataggagagggttagaatatcattccaatgacagtcagaaaggtcaaggggtcgagcccccaatgatgacctcccaaagatgcatataaacccccacccaaaacccaattggccagaagcccatgtatcttccatagaagaattacagggtcgatccccagtgctgcataacaacgaaataaactccatgaattcacagtttgacttccaatcgatttctactaaaagttgctgacagggattcggatatttgaccacatgcctttttaaacttctattcatgaattaaaattacaccaccattttttaaaagatcgccaacatgattgtatttcagcctcaaacagttatcagaattagtgggacttcgaagagtacctgagatttgaaaaatgtaggaagaaaaggattgaatcagcaactataatcacagcagcaagaccaaccgtaacaaatgagaaatcacagcccaggagtgtttaaatcagtcaaacaaatgcttgaaatcagcaggaacttgaagacccaaaaacagaaatcacaagccaaccaaattgaacccaaatcaactccaaatagccccaaaacactgtaaggcaagacttctaaagagaaatccagaaaaaaaactgtctgaaatcaatgaaatagtaacattttgtcacgacccggatttatcccaccaacgggtatcgtgatggcgcctactgtcgtagctaggcaagccgaactaacacatattcaacagtaatattcaacattaaataattaataagacagaaaaatatgcggaagacttaattaaattaataacagcaaaacgcggaagaatctattacatcctctacccaagaaccagtgtcacagcgtacagacttctaaagagtcactacaaccaagcgtttgaaatagaaatacatagaagtgtctgtctgaaactaataaacaaactaagtgataggagaggctggagggtccacggacgccagtgaactacctctcagtctctggactgaaggctggctcctcaatcagtgctggtgtgctccaaactctgctcccggatctgtgcacaaaagggcacagaagtgtagtatcagcacaatccgaccccatgtgctggtaagtgcctggcctaacctcggtccacgaggtagtgacgaggctagaccggacctacaacgttaacctgtgcagaatatatatatatatgcgaagcaggagaaaatagtacatgaattaaacaagtatgggaggggacatgctataagggggaacagttcaataatttaaagtacaactaactaaacagataatcagaaaccaataataataaagcatcaaataagcatatcttgtggtaggcgtaccacccgccctcatttcatcatatcctgtggtaggcgtaccacccgccctcattttaacatatcttgtggtaggcgtaccacccgccctcattttatcatatcttgtagtaggcgtaccacccgccctcagttttatcatatcttgtggtaggcgtaccacccgccctcatattatcacatcttgtggtaggcgtaccacccgccctcatattatcatgtctttcagctcaattcatttatacacaagtcctatatcagggaaacacaacaatttacacatatttatctaacccggcaagggtgcagctataaccaatcaatcccagcaagggacatgagaaacatatagaattcgaccttactagacatggcatttcactttaattattcaaataagccatttaagtcgtttgaaaccaacaatttacttataaggttcaattcaatagctaaaatccatatcatagctttcaacaatctcaagtaaagacccacggtcatgctttgactcgggtgcataggtaaccgccaccaaacctatacaccgacccatgtaacacatagcaaataacttcctagtcctaatccctcgaactagagttagaacaaacacttacctcaatgccgaactagaaattcaaagctctacaaccgccttccctttcgaatccaactcccaaacaacgatatctaagcaatattagattcaaaatcatcaataacaactcaataattcaactccaaagcctagaaatgaaatcccaaactttcctccaaaaattccaaaatctgaccccgggcccacgtggtcgaaactcgaggtttggaccaaaacccaatcccccatatccccacgagttcaaatatataattagttttcaaatccgacctcaaattgaggtcgaaatccccaaaatcacaaaagccctagtttctacccatttcccattttctacttagatttcatgaattaaagagaggaagttcaataattgaggaagaaatgatgaaagaattgagttaggattaacttacccaagggttgttgaagatttggaccttgaattttcgtcaatggagagaaaagtgggtgagttcgtgtgtaaaaattgagttatggtcgaaatacactgttctggaattaaatatttcgctgggcaaatttaccctatgcgatcgcggatgtaggagtgcgatcgcatagaggactgagttctgaagcatcgcgatcgcagggctggtcctgcgttcgcatagaagaaacgggggggtcaggtcctgaggagaaaatgcactacgcgatcgcgggggctcgaacgcgatcgcattgaatagatatccaatgaaacgcgatcgcaaggggaagtatgcgatcgcagagagtaaacggaggggcttacaaacttactctatgcgatcgcggaggcttgaatgcgatcgcatagggcaatttcagggtctgcaacagctgaaccaaaacactagatttttcaaacaaataccctccgaaccacccccggaaacactcccgagccctcggggctcccaaccaaacactcaaactaactcattaacatcctacaaactcgctcgagcaatcaaatcgctaaaacaacatccaaaacatagaatcaaaccataaaatctccaaatttcaactttagacttcaagttctcaaattagctataagggtccgaatcacgtcaaacgacgtccgaattcgaccaaattttacaggtagcgcttaaacgctacataagacctgtaccgggcgtcgaaaccaaaaaacgagcccgatacgacatttaacagacaattattcaatttcaaagacttaggatagtttcaaaaactattttcacagaaaattccgtatcttgggcctgggacctcagaattcgattccgggcatatgcacgagtcccaaatttaatgacggatattcagaaattgatacgacacgggtccgaacccgtttgcccaaaatgttgaccggagtcaactatagcaatattatacttgaatttcaccattttaaacatagaattcatttttcaacatagaaaatctttccggcttcgcgcccggactgcgcacgcatatcgaagcaacctctcaagaggttttcgcggactcagaagcacggaacaaggagcatttatggtgatgaccccattgggtcgtcacaatctccacctctaaaacaaccgttcgtcctcgaacggacaaaagaaagaagtacctgagtcgggaaatagatggggataacggctccgcatatcggactcggactcccaggtcgaagcctcaggaggctgacctctccactgaacacgaactgagggaaaactcttcgacctcaactgtcgaacctgcctgtctagaatagccaccggctcctcctcataagacagatccttgtccaattggacagtactgaaatctaatacatgcgagggatcgtcgtgatacttccggagcatggatacatggaaaactggatgcacagctgataaactaggtggcaaggcaagtctataagccacctctcccactcgctctaagatctcaaatggaccaatgaacctagggctgagcttgcccttctttccgaatctcatcacgcccttcataggcgacacacggagcaatactcgctctccaaccatgaaagcaacatctctgaccttgcggtctgcataacttttctgcctagactgagctgaacgaagtctgtcctgaatgatcttgaccttatctaaggcctcctgaaccatatcaacacccaataaccgagcctctcccggctcaaaccatccgactggggacctacaccgcctaccatacaacgcctcataaggagccatctgaatgctggactgataactattgttgtaggcaaactctgctaaaggaaaaaactggtcccacgagcctccaaagtcaatgacacaggctcgaagcatatcctcaagaatctgaatcgtccgctcggactgtccgtccgtctgtggatgaaatgttgtgctcatctgaacccgagtacccaactctccatgcaaggctgtccaaaaatgagaagtaaactgcggacctcggtccgaaataatagatacgggcactccatgaagacgaactatctctctgatgtaaatctcagccaatctctgggacgaataggtggtagcaactggaatgaagtgcgctgacttagtcagcctatccacaatcacccaaactgaatcacactgcctccgagtcatcgggagactagtaacaaagtccatagtgaccctctcccacttccactcgggaagctcaatcctctgaaatagaccaccaggtctctgatgctcgtacttcacccgctgacagttcaaacaccgagcaacataagcaactatatctctcttcatcctgcgccaccaataatgctgtctcaagtcctgatacatctttgcggcgcccgggtgaatagaataccgagaactgtgggcctccgctaagatcaaatcacgaataccatcaacattgggcacacaaactcgtccctgcaatctcaatacaccatcatctcccaaggtcactttcttagcacctcctcgctgaaccgtgtctctcaggacacataaatgggaatcatgaaactgaagctcgcgaatacgctcaaatagagaagagcgggcaaccgtactagccaaaaccctgctgggctccgaaatatccaatctgacaaaacgattggccaaggcctgaacatctatggcaagcgatctctggccgactggaataaaagcaaggctacccatactagctgactttctgctcaatgcatcggccaccacattggccttacccggatgatatagaatagtaacatcataatctttcaacaactctaaccatctcctctgcctcatattcaactccttctgcttgaacaagtactggagactcttgtgatcagtgtaaacctcacacgtcacaccatataagtaatgcctccaaatctttaaggcatgaacaatcgctgccaactcaagatcatgaactggataattcttctcgtggatcttcaactgtctcgaagcataggctataaccttaccattctgcatcaaaactgcaccaagcccaacacgagaagcatcacaatagaccgtgtacggtcctgaacctgtaggcaataccaacaccggtgccgtggtcaatgctgtcttgagctactgaaagctcgcctcacactcgtcagaccacctgaataaggcacccttctgggtcaacctggtcataggggatgcaatggatgaaaacccctctacaaaccgtctgtaataaccggctaatcccaggaaactccgaatctctgtagctgaagctggtcgaggccagttcttgactgcctctatcttcttcgggtctacctgaataccctctgctgaaacaacatgacccaagaatgccactgaactcaaccagaactcacacttagaaaccttggcatacaactgactatccttcagagtctgaagaaccactctgaggtgttgctcgtgctcctcctgaccgcgggagtatataagaatatcatcaatgaagactatcacaaataagtccaagaaaggcctgaatactctgtgcatcaactccataaacgcagctggggcattagtcagcccaaatgacataaccaggaactcgtagtggccatagcgagtacgaaaagcagtcttagggacatcagacgccctaatcctcaactgatgataaccggatctcaaatcaatcttggagaataccttcgaaccctgaagctgatcgaataagtcatcaatcctcggcagtggatacttgttcttgatcgttaccttattcagctgccggtaatcaatacacatcctcatagaaccgtctttcttcttcacaaagaggactggagcaccccaaggtgacacgctgggtctaatgaaaccattctcaagcaaatcctgaagctggtctttcaattctttcaactctggcggcgccatgcgataaggagggatagaaatgggctgagtgcccggcgccaaatcaatacagaaatcgatgtccctgtcgggcggcatgcccggcaaatcagaagggaacacctcggggaactcccgaacaatggggacagaatcaacagacgggacctcagcgctggaatcgcgaacataagccagataagctaagcaccccttctcgaccatacgtcgagccttcacataagagataatactacgagtggtacgactgggggtccctctccactctaatcggggcatatccggcaacgccaaggtcacggtcttggcatgtcaatccaagatcgcatgataaggagataaccaattcatcccaagaataacgtcaaaatccaccatatccagcaacaataagtcaacacgggtctcaagacccctgaataccacaacacacgagcgatggacccgatccaccactatagaatcccccactggagtggacacatggacaggaatactcaaggcctcactaggcataatcgcacaaggcgcaaaatatgatgacacatgggaatacgtggatccaggatcaaataatactgaggcatctctatcacagaccagaatagtacctgtaatcacggcatcagatgactcggcctcaggtctggccggcaaagcatagcaacggggctgggccccacctccctgtatgacatctctaggctgatctacaactgcctgacctctaccacgagctagctgagctccacctctaaggcctctgcctcctcctctatgacctctgcccccgcctctagctggctgggcaggctgtggggcaggtggtgcctgaatcatgggacggggtccctgctgctgcgaactgctggaagctctggggcaaaacctggcgatgtgtctagtatcgccgcaagtgcaacaagctctggtctgctgaggaaatctcaaaggagctgcactgatgggtgcggaaggcgaactgtacaactgctgatcggaggactgaacctgtgaaccacgcccacctggggcaccctgagaagtctggagagctgactggaaaggcctcgggggctggcccctagcatgtgaacccctgcctccagatgaggtaccactgaaatgaccagaatgacggggcctcttatctgacccagttccacctcccaaagacaatgccatctcaatccggcgggcaccattcgccgcctcctgaaaagatagaccactatcggcactcatggccatctgcacccggatatccggatgcaacccatccacaaatctcctgaccctctcgctatctgtaggaagtagcactaaggcatgacgagccaggtccacaaaccgcgtctcatactgcgtgactgtcatatatccctgctgtagacgctcaaactggcgacggagagcctctctctgagtaacggggagaaacttccccagaaataactccgcgaactgatcccatgtcaaagctggagaccctgctggcctagatagacagaaatccctctaccaagtcttggcggatccagtcaggcgaaaggtggcaaaatcaactccattagtctccacaatacccatagtcctcaaagtctcatgacaagtatatagatagttctgagcatcctcagaaggtgcaccatcactagtctggcccgcaacaactgccggaacgggcacaactgaaggagctggggcaacctgatatacaggtggtgcctctggagtctgaagtccctgcaccactggctcgggtgtatgcataactggggtctgagtacctcccccaggctgagaagtggcaactgcggcggtggctgagaccacctgtgctagactagagcacgctgacatgatctgagctagggcctcctgaagacccgggacgaccataggaatagctggggctggagtcccctcagcctcaatctggggctccgcctctggcactgcggctcggggctaagctctgcccctgccacggcctctagcgcggcctcgtcctctgcccctaactggaactactgctggggcatcggcctgctgatcagaagaagaggaagctcgagttctcgccatctgcgaagaaatagaatagagagacaatcaatattgagaaacagaatcgcacgacaagaatgaacaaagtgagatttttcctaactctgtagcttctggggaacaagtacagacgtctccgtaccgctccctcagactctaccgagtttgtccgtaagctgtgagactcaagtaacctagtgctctgataccaacttgtcacgacccggatttatcccaccaacgggtatcgtgatggcgcctactatcgtagctaggcaagccgaactaacacatattcaacagtaatattcaacattaaataattaataagacagaaaaatatgcggaagacttaattcaattaataacagcaaaacgcggaagaatctattacatcctctacccaagaaccagtgtcacagcgtacagacttctaaagagtcactacaaccaagcgtttgaaatagaaatacatagaagtgtctgtctgaaactaataaacaaactaagtgataggagaggttggagggtccacggacgccagtgaactacctctcagtctctggactgaaggctggctcctccatcagtgctggtgtgctccaaacgctactcccggatctgtgcacaaaagggcacagaagtgtagtatcagcacaatccgaccccatgtgctggtaagtgtctggcctaaccccggtccacgaggtagtgacgaggctagaccggacctacagcgttaacctgtgcagaatatatatatatatatgcgaagcaggagaaaatagtacatgaattaaacaagtatgggaggggacatgctataagagggaacaattcaataatttaaagtacaactaactaaacagataatcagaaaccaataataataaagcatcaaataagcatatcttgtggtaggcgtaccacccgccctcatttcatcatatcctgtggtaggcgtaccacccgccctcattttaacatatcttgtggtaggcgtaccacccgccctcattttatcatatcttgtggtaggcgtaccacccgccctcagttttatcatatcttgtggtaggcgtaccacccgccctcatattatcacatcttgtggtaggcgtaccacccgcactcatattatcatatctttcagctcaattcatttatacacaagtcctatatcagggaaacacaacaatttacacatatttatctaacccggcaagggtgcagctataaccaatcaatcccagcaagggacacgagaaacatatagaattcgaccttactagacatggcatttcactttaattattcaaataagccatttaagtcgtttgaaaccaacaatttactcataaggttcaattcaatagctaaaatccatatcatagctttcaacaatctcaagtaaagacccacggtcatgctttgactcgggtgcataggtaaccgtcaccaaacctatacaccgacccatgtaacacatagcaaataacttcctagtcctaatccctcgaactagagttagaacaaacacttacctcaatgccgaactagcaattcaaagctctacaaccgccttccctttcgaatccaactcccaaacaacgatatctacgcaatattagattcaaaatcatcaataacaactcaataattcaactccaaagcctagaaatgaaatcccaaactttcctccaaaaattccaaaatccgaccccgggcccacgtggtcgaaactcgaggtttggaccaaaacccaatcccccatatccccacgagttcaaatatataattagttttcaaatccgacctcaaattgaggtcgaaatccccaaaatcacaaaagccctagtttctacacatttcccattttctacttagatttcatgaattaaagagaggaagttcaataattgaggaagaaatgatgaaagaattgagttaggattaacttacccaagggttgttgaagatttggaccttgaattttcgtcaatggagagaaaagtgggtgagttcgtgtgtaaaaattgagttatggctgaaatacactgttctggaattaaataattcgctaggcaaatttaccctatgcgatcgcggaggtaggagtgcgatcgcatagaggactgagttctgaagcatcgcgatcgcagggctggtcctgcgttcgcatagaagaaacggggggtcaggtcctgaggagaaaatgcactacgcgatcgcgggggctcgaacgcgatcgcattgaatagataaccaatgaaacgcgatcgcaaggggaagtatgcgatcgcagagagtaaacggaggggcttacaaacttactctatgcgatcgcggaggcttgaatgcgatcgcatagggcaatttcagggtctgcaacagctgaaccaaaacaccagatttttcaaacaaataccctccgaaccacccccggaaacactcccgagccctcggggctcccaaccaaacactcaaactaactcattaacatcctacaaactcgctcgagcgatcaaatcgctaacacaacatccaaaacatagaatcaaaccataaaatctccaaatttcaactttagacttcaagttctcaaattagctataagggtccgaatcacgtcaaacgacgtccgaatttgaccaaattttacaggtagcgcttaaatgctatataagacctgtaccgggcgtcggaaccaaaatacgagcccgatacgacatttaacagataattattcaatttcaaagacttaggatagtttcaaaaactattttcacagaaaatttcgtatcttgggcgtgggacctcggaattcgattccgggcatatgcacgagtcccaaatttaatgacggatattcagaaattaatacgacacgggtccgaacccgtttgcccaaaatgttgaccggagtcaactatagcaatattatacttgaatttcaccattttaaacatagaattcatttttcaacatagaaaatctttccggcttcacgcccggactgcgcacgcatatcgaggcaacctctcaagaggttttcgcggcctcagaagcacggaataaggagtatttatggtgatgaccccattgggtcgtcacaatttttgtggtttttcgcttttgtatcttttttcttgtcttgttttttgtatatcaagctaatctgaaactaatttttgaaatgaaagagaacttcaaagctgaataaaaaaagctgtatgttttctggaatctttctcatggaaggaaccccttcaaagaggccttaagagtgccttttataagctagaatgagggcagccctcaaattcttaattactctaaaagtccctcacttatctcatttttaaaccctcatttcctgacttgttctacaagttactgccctaagtctttgaaaactacactaaagccctactctagaaggtcctaggacactctttaagtgagacaaaaccccaaactacccttgtcttattttaaaattacaaatcctaaagattctacccctttctatccctaaaaagcctttgaaacctccctaatattactgactacaccacaaccttactccaatctcataccttagtaaaaagaacttaactgcggttaaacctagaactaatttccttcagctaaccaattcaatctatttacaaagaactaattaacactaacaaggattaatgctaacctgaagagaaattgctaattaaaatacctctaaacactgagattatctagaataaacttgacgactgattatttaattaatactacgattaccagaaattaaactaaatagctaagatgattaaaagaaactcggatcgaaagaggagaaaaggagcagtcaccattcaaaaaacatcaaaactaaaactcaacataatctaactagcaaaacttaactaataatgattacaagatgacgagaaataatgagatgaatcagaacttattaatcaacacgaaacaaaagattgggcatcacaggacagaaattaactaaatcgataattatctattcgaaatgagtaccagaaacagaagaagaagaagaacaaagacaaacaacgaaaaagaaaagcgaaacgggaaaaacttaccctcgaacctctgctcagaaacgaactcgccggaatcggggtccggttaatgttgttggtccatttaattcaaaatggactaacaactttaactagaaaccggttcggctccaaagtcttcaaaccagtctcaaactgacgaaccctagatttgaaatttgtgaagttccaatcagatgcggaaagttttggttgaggatttaggctgagggggttgaggagactgcctggtgcgattttggtcgaatttggaagtgatgagactttgagccggaacttcaaactgatattcgaagggttcggaatggatttgatggaaattaacaccggatatggaaagcgggggacaaggagaggttggggtgtaattttgggggcgaatagaggtggcgccgccacccatggaggtggagcatttggtggcggctcagattagggtttctgagggggggggggtggacgagagagacgatgaggggggtatggggaggggttcggacagtcatataccaaatagaccccacttcctgaccgttcgatcatctaatcctagacggtccagattgcactccaataaaacgtcgtcgtttcgggggtcaggggattggaccgggtctggaggttgtttgggctggattggacgagtggaaatgggctgcaaattggcccaacaatgcccttttattataagcctctttcttattttttaattgtttttctcttcttttttttctttttgtttgttctttttcattttataatttttacactttttctgatttataaaaattgcagaaattaaaataaaaattaaactaaactaattaatacctaaattaccttaaaactattttgcgacaatttcacaattaaaacaaataaactgcaaaagtgaactatttttgagattttttatattctgttctaaaacaaattaacccgtaattaatcctaaagtatgaaattagatcctaaatgcaaatgcgtatttttgtattttatatgaattaaaatgcacaaataaaatgcaaacaattaacagaaaattcacaaaatcgtaaaaacaaggaaaaatctttttgtttgaattttatgggaattattcatatatagggcaaaaatcacgtgctcacaccttgcatttagggttgggaaatttgtttaataattagaatatgaatttttgagcatgtattgactagttcttacccaatttgaatagttttggatcgttcggctccaaattggaggtttgagcgcgttcttgaatcggaatatagacttcggagcgaggtgagtctcctttctaaccttgtcagagggaattgtccccataggtaaaataattggttatgtgctcctatttttggggggctacatatgcacaaggtgatgagagtccgtgcgtagctactattatgtttatgtccaggtagtctaggatccaaaagcatgctatacttggaatatttataatcttattgacagttgaatttcttaaatcctatcgaattggtacataaatttccaaaaggattaaacttcattttcttaaattgctaaaagagaattggcttttatttggataaacgttccccaataaattcttaatttgctgtttgagcatgtatttctatgtgtgcctgcgtcgcatttatgattcgcgagcagggtgtttgtttatttatgttgaccgtgtcacatgtatgattcgcgagcggggtaatagatgcatctatggttcacgccgttcgaccctcggcagtgcacattttacatttatgttggatcgggtcgtacgacctcaacatgatatgcgcatgcttgtattgttgcctgagatttataaatattgatatttgtctttcctggccggagataaattgataaaagatgatgaaaagtaaatctttgcaattcattattatttgagaagttgtttacctattatccggctttatgagtttataattgcttcataaaaattcatgatctcctccctttttttttacaattattattattggaccactagtaagtgtcgaagtcgacctctcgtttctacttctttgagattagacgggatactcattgggtacacgttattttcgtactcatactacacttgctgtgcatttttattgcacaggcacatgcatctctagtggcctagtgggcgtagcagcatggttgatacagagacttaggtgagctgcacttctcgagatgatccgcagccagcagagtctctttcagattactgtatttactttctgtcaaatattgtattcggatggttgttgtattatattatttcctagaaattgctcatgcacttgggacactaggttctgggatgactatgggtattctatatttactcctaaacattcttttatttatttttcttttgcaaagattatcttttactagttgaatggaaggaaaatttcagttttcaaaattattaagataagaatttaattaagtatttttgttggcttgcctgatagcggtgtttggcgccatcacgacccttagtgaattttgggtcgtgacaacatggtatcagagcactaggttctcttaggtcttacgagtcatgaccaagtctagtagagtctcgcggatcagtacgtagacgtttgtacttatcttcgagaggctacaggactgttagtatgacgacccaaagggtcatcacttgcttttaattgaattctgtgcctccgagtccttgaaaacctcatttcgagtcgcctcaatttgtgtgcgcagtccgagcgcgtatccgaaaagtttaaatataaaattttgtgaaaaatgctaagctttgattataaaatgagtaaatttgactttgttcaacattttagggaaacggaccagtacccgtgatccgacggtcccggaggatccgtaggaaaatatgggacttgggcgtctgcccaaaatcgaattccgaggtcccaagcccgagaaatgaatttttaagtaaaaaaaaaattttgaaaatgtttatggaattttgaaatgaaatcatattagaaagcaatggtattgggcccttattttgtttccggcacccggtacaggtcttatatatagttgaagtcattcctgtaaaatttgattaaaaacgaacgtcgtttgacgtaattcggacctaaattgctaaatttgaaacgtaatgaagtttgagaaaagttcttgattttgaagtttgattcattatttttgaggttattttggcgatttgatcgcacggataagttcgtatgatgtttttgagttagtacgtgtgtttggttaagagccccgagggctcgggtgtgtctcggatgtgtttcgggaagttttgaacttaggaaattattgcagattttttgctgttagtgcccagggattttactcttcgcgttcgtgtggtccctcacgcgaacgcgtaaggcaaagatcccaggtgccatttggattcttcgcgaacgcggaggttgagacgcgaacgcgaagcttagggggagacccttcgcgaatgcgtaaggttgagcgggaggggtcaccacttgtgcgtcgtgaatttgaccactagtccgcaaatgcgtaggcttgaggagccaaagctccgctaacgcgagccacttttcgcgaccgcgaaggcctaacaggcctaacccaccgcaaacgcgaagggcatgtcgcgatcgcgaagaacaatttcgcccagttattttaaagacccaaaacagaacacttacgggatttatcaaaatttcacaaaacctcttcttctccaaagctcttaggcgagctttgaagcaaatcttcaccataatctcttgggtaagtaatatctaactcgtttccttcattttccatcaacacccactagattactaagcctaaaacatgtaattaagggtagaaattagaaaattgggtagagttagggattattgattaattgtgatttagacctcgttttggggtcgaattctaaaaataatcatatattcgggcttgtggatgaatggttgatttgattttggtttgaacattgtgttttgaccaagcggacccggggtcgatttttgggatttttggaagaataattggaaagttataattgaacattggaattggattgtttagcatttattgatgttattaagtcaattatgtatagattcgattgagttggagccgaatttgaaaggaaaagcggtatttgaggcttgagttggccgtggaagttcgaggtaagtgttcggtctaaccttagcttgagggattaggtgttgagtcctatttgctacttgtttcttgttaaatacgacgtataggcatggtgacgagtatctatacgttggtgtcgagcatgaccgtgagtcttaaatttatacttgttgtattcttgaatgatgttatgcttccaatagtgataatccttgatattgagcaaagacttagtttattttcgagaaatctatctatgatttagtaatggtgatagctgagctgagtaagagttgagttagaattggttatagctgattctcctttgccgggatgtatatacttgttcagttgggttcccttgcacggaaagtgtagcttattgttggtcccttgacggggcggttattatgatttatgttgactgtatatatggaacgggttgtgcgccgcaacattattaaatgtggatcgggttgcacgccgcaacactattatatatggatcgggttgcacgccgcaacaataatatgttggatcgggttgcacgccgcaacaaatattatgccggatcgggttgcacgccgcaacaattatattatattgcatcgggttgcacgccgcaacagagttaaatgataagggatcgggttgcgcgccgtaatagtagtattattgtgttgttgtagatactgtactgtcttccttacttctgttcagttttctgttagattaaaatgtttccccgaagcatgtttcccctacctttttaaactgcttattacctgtttatttttccgccatatattatataactgcacaggtttatctggagtctggttctagcctcgtcactgcctcgccgggcttagtccagacacttaccagcacatgggttcagttatgctgatgctacactctgcacttatgtgcagataccggagccggatttggtcagtagcagtagctcgggagctagccttcagtccaccgagacaccgaggtagccttgcaggcgtccgtaggcctggcgtctcctctatcttattttgcattctattatctcatgtattcgagacaaacaatattatttttcttccaaattgttgtatgtagcactcttagaagtccgtggatgctgtgacaccaggttctggttagaagcatatgttggtttcgagatattttggttttgcatttacttaagactttcgctaaatttcatatttcactgttatttaactgtttatttcttgttaatgtaattggaaaaaagatttaaaacaaatgagttaataaattctaagttcatgacttgcctagcttctataagtaggtgccatcacgactcccgagggtgggaaatctgggtcgtgacaagttggtatcagagcactaggttacataggtctcacaactcacggacaagctcagtagagtctatcagatcggtacggagacgtctgtatttatcccctaggggctacaaagtttggaaaacttcacatttgttctttcttgtcgtgcggttttgtttctcaatactaattgcctttctactctgttctttcgcagatggcgagaacacgcgcttcctcatcaaccgctcagcagcccgagcccccagcagcaactcccacgaggggcagagggtgaggccgagctagaggccgaggtaggggcagagctcaaccccgagcagcagcaccagtggcggagcctcaggttgattttgatgatgaggttctggccccagcagtttcagtgggcccagctcaggtccctgagggttttttgggtaccctagttcttcaggatgctctggtccgattagtgggcctcatgaagagtgttacccgggcgggcttttttcctgtagcaccagccacttctcaagcttgaggaggagcccagactcctactactcgcacttcggagcaggtagctccccagattcagactccagcggttcagccagttggagcagttcagcagggtgtggtagctcacactggcgatggagtggctatgtccgccgatgttttgtggagattggacagattcaccaagctcttcactactactttcagcggtgcttcttctgaggatccccaggattatctatacagctttcacgaggctctcaggaacatgggcattgttgagaccaatggggtcaattttgctgcatttcgcttgtctagatacgccaagacttggtagagagattactgcttggctagaccagccggatctccagccttgacttgggagtagtattcagttttgtttcttgagaagtttctccccgttactcaaagagaggcctatcggaggtagtttgagcgcctccagcagggttccatgactgttacccagtatgagaccaggttcatcgacttagctcgccatgctcttgtcatacttcctaccgagagagagagggtgaggaggtttattgacagtcttattcagccgattcgtcttcagatggctagggaggttaggagtgagatcacttttcaggaggtggccaatgtggcctgcagggttgagatggttctgtcacagggaggtagtcatgggtcggataagaggccccgtcatttaggcagattcagtggtacctcgtctgaaggtagagattcatatggtagaggccatcctcctaggccctttcagtcagcctttcaggtttctcacagtgcttcaggtagtcgtggtcgtcagatgcagtattctgatcagcagtccttcagtgcaccaccagctcctatcagtgcagcatcgctctagagttttcgagtggtcattcaggtcgatagggtcagtctcagtttcctcaaccgtagcatttgggtggatgttatgagtgtggtgagtatggtcatatccagagggcttgtctgaggttggtgggtactcaaccgcagcagaagggttctcgtgctatagttccggcactagttattccacagaccgcccaaccagctagaggtaggggtagaggtgctagaggtggaggtagaggatttagaggtggagctcagactgccagaggtggtggccagccagctggaggccgtcccagagaggtagtccagggtggtggggcccagcgccgatgttatgctcttccagccaggcccgaggctgaggcttcagatgcagttattacaggtacgattctggtttgtgatagagatgcttcagtgctatttgatctagggtctacgtattcgtctgtgtcatcttattttgcaccggacctggtcatgcctagtgatttattgagtattcctgtttatgtgtctacaccggtgggtgattctatcgtggtcgatctagtccatcgttcttgtattgtggtgattgggggtcttgagacccgtgttgatttgttgcttttagacatggttgatttcaatgttatattggggatggactggttatcaccttaccatgctatcttggactgccatgccaagactttgaccttagctttacccggtttgcctcgtctagagtggagaggcactcctggtgattctactcgcagtgttatctcgtatgtgaaggctaggcgtatggtcgagaaggtgtgtccggcctatttggcgtatgttcgtgattttagtggcgaggttccctctattgattctgtgcccgttgttcgtgagtttcttgaggtattcccttgagacctgccgggtatgccgtccgatagggatatttacttttgcattgatttggctccgggcactcagcccatttccatttcgctgtatcgtatggctccgcctgagttgaaagagttgaaggaacagttgcaagacttgcttgagaagggtttcattagacccaatgtttcgccttggggtgcgccgctgttgtttgtcaagaaaaaagatggttcgatgagaatgtgtattgattaccggcagttgaacaaagttacaatcaagaataagtatccactaccgaggattgatgatttgttcgatcagcttcagggtgccaaggtattttcaaagattgacttgagatctggctaccatcagttgaggattagggcatccgatgtcactaagacaactttccgcactcggtacgggcattatgagttcttggttatgtcatttgggttgaccaatgccccagcaccttttatggagttgatgaaccgagtgttcaggacttatttagacttgttcgtgatagtcttcattgatgatattttgatatattcccgcagccaggaggagcacgagcagtatctcatagtggttcttcagactctgaaggatagtcagttatatgctacgttctcgaagtctgagttctggttgagtttagttgcattcctgggtcatgttgtatcagtagagggtatttaggttgatccgaagaagattgaggcagtcaagaactggcctcgaccaacatcagttacagagattcagattttcttaggattcgcaggctactatcgtcagttcgtggaggggttttcatctattgcaaccccgatgactaggttgacccagaagggtgcccagttcagatggtcggacgagtgtgaggtgagctttcagaagctcaagacagctctgactacggcaccagtattggttttgcctacaggttcagggccttatacagtttcttgtgatgcatctcgtattgggcttggtgcagtgttgatgcatggtagcaaagtcattgctatgcttcgcggaagttaaagattcatcagaagaattatacgattcatgacttagagttggcagccattgttcacgcattgaagatttggaggcattatctgtatggcgtggcatatgaggtgttcactgatcacaagagtctttagtatttgttcaagaaataggagttgaatttgaggcagagaaggtggttggagttgttgaaagattatgatgtcactatcttgtatcacccggggaaggccaatgtggtggccgatgctttgagtaggtcagctagtatgggcatcttgcttacattccgatcggtgagaggccgctcgctttggatgttcaggacttggccaatcggttcttgaggttggatatttctgagcctagtcgggtattagcttgcacggccgctcgttcttcattattggagcgtatccgtgaacggcagtttgatgatccccatttgtgtgtccagagacacggtgcagtggggaggtgccaagcaggtgaccttcgacgatgatggagttttgagattgcaagggtgagtttgtgtgcctaacgtggatgggctccgagagttgattttagaggaggcccatagctcccgatactctattcatccgggcgccgtgaagatgtatcaagatttgcggcaacattattggtggcgtagaatgaagaacaatatcgttgcatatgtggctcggtgtttgaattgtcagcaggttaagtatgagcatctgaggcctggtggattatttcagaggattgagcttcccgagtggaagtaggagcggatcactatggatttcgttattaggctcctgtagactcggaggaacttcgacgcagtatgagtcattgttgataggctgaccaagtcagcgcatttcattcctatggcagtctcttattcatccgagaggttagccgagatctatatccgggagattgtttgtctttatgtcgtgcctatgtctatcatttcggactgaggtatgcagtttacctcgcatttctagagagcagttcagcgagagttgggcactcaggttgagttgagtacagaatttcatccccagacggacggccagtccgagcggactattcatatcttggaggatatgctctgagcttgtgtcattgactttggaggctcgtgggatcagtttttgcctttcgtagagttttcctacaacaacagctaccagtcgagtatctagatggctcattatgaggcgttgtatggtaggcgatgtcgatctacgattggatggtttgagccgggggaggctcggttgtttggtacggatctggttcaggaggccttggacaaggtcaggattattcaggataggcttcgtacagctcagtccaggcaaaagagttatgcagaccgcaaggttcgagatgtggcttttatggtctgtgagcgggtattgctccgagtgtcacctatgaagggcgtgaagagattcgggaagaagggtaagcttagccctaggttcattggtctatttgagattcttgatagagtgggagagttgacttatagacttgcattgccgcctagcttatcagccatgcatccagtgtttcatgtgtccatgcttcggaagtatcacggcgatccatcccacgtgttagatttcagcactatccagttggacaaggatttgtctaatgaggaagtgccggtagctattctagaccggcaggttcgtcagctgaggtcgaagagttttccttgtgttcgtgttcagtggagaggtcagcctcctgaggcatcgacctgggagtccgagtctgatatgcggagccgttatccttatcttttccccgactcatatacttctttcttctgtccgttcgaggacaaacagttattttagaggtggagaatgtgactacccaaagggtcatcactttgttttaattgaattctgcgtctacgaggccttaaaaccctcatttagacttgcctcaatttgcgtgcgcagttcgggcgcatagccgaatagcttaaatatgaaattctacgaaaaatgctaagttttgattataatatgagtaaatttaacttcggtgaacattttgggtaaacggacccggacccggacctgtgatccggcggtcccgaaggatccgtaggaaaatatgggacgtcgtttgacgtgattcggacctaaattgctaaatttgaaacttgatgatgtttgagaaaagttcttgattttgaagtttgattccttgtttttgaggttattttggcgatttgatcgcacggataagttcgtatgatgttgttgagttagtacgtgtgtttggttaggagccccgagggctcgggtgtgtttcggatgtgtttcgggaagttttgaacttaagaaaatgttgcagattttctgctattagtgcccagggattttacccttcgcgttcgcatggtccctctcgcgaacgcgtaaggaaaagatccaaggtgccattttgcttattcgcgaacgcgaaggttgagacgtgaacgcgaagcttaggggggagacccttcgcaaacgcgtccttccactcgcgaacgcataaggttgatggggaggggtcaccacttgtgcatcgcgaacgcgaccactggtccgtgaacacgtgggcttgaggagcaaaaagtccgcgaacgtgagccactttccgcgaacgtgaagatctaccaggcctaacccatcgcgaacgcgaagggcatgccgcgatcacgaagaacaatttcgcccagttattttaatgacccaaaacagaacacttatgggatttatcaaaatttcacaaaacctctttttctccaaagctcttaggagatctttgaagcaactcttcaccataatctcttgggtaagtaatctctaactggttttcttcattttccatcaacacccactagatttctaggcctaaaacatgtaattaagggtagaaattagggaattgggtagagttagggctttttgattaattgtgatttagatctcgttttggggtcgaattctggaaaacattatatattcaggttcccggatgaatgggtgatttgattttggttcgaaccttgtgtttttaccaagcgggctcagggtcgatttttgggattttgggaagaatgattggaaagttataattgaacattggaattggattttttagcatttattgatgttattaagtcaattatgtatagattcgattgggttggagccaaatttgaatggaaaagcgatatttgaggcttgagttggccgtggaagtttgcggtaagtgttcggtctaaccttagcttgagggattaggtgttgagtcctattttctaattgtttcttgttaaatatgacatataggcatggtgacgagtatctatacgttggtgtcgagcaagaacgtgagtcttaaattgatacttgttgtattcttgaatgatgctatggttgcaatagtgataatccttgatattgagcaaagacttagtttattttcgagaaatctatttatgatttggtaatggtgatagctgagctgagtaagagttgagttaggattggttatagctgattctcccttgccgggacgtatatacttgttctattgggttcccttgccgggaaagtgtagcttattgttggtcccttgccaggacggttattatgatttatgttgactgtatatatggaacaggttgcgcgctgcaacattattaaaaatggatcgggttgcacgccgcaacactattacatatggatcgggttgcacgctgcaacaatgatatgttggatcgggttgcacgccgcaccaaatattatatcggatcgggttgcacgccgtaatagttatattatactggatcgggttgcacgccgcaatagatttaaatgataagggatcgggttgggcgcggtaacagtagtattattgtgttgttgtagatactgtattgtcttccttacttttgttcagttttctgttacaatgtttccccaaagcatgtttcccctccctttttaaactgcttattacatgtttatttttccgccatatattatataactgcacaggtttatttggagtctggttctagcctcgtcactacctcgccgcggttaggccagacacttaccagcacatggggtcggttgtgctgatgctacactctgcacttatgtacagattctggagccggatttggtcagcagcagtatctcgggagccagcctttagtccaccgagacaccgaggtagccttgcaggcgtccgcaggccccgcttctcctctatcttattttgtattatgttatctcatgtattcgagacaaacagtattatctttcttccaaactattgtatgtagcactcttagtagttcgtggatgttgtgacaccaggttctgggtagaagcatgtgttggtttcgagatattttggttttgcatttacttaagacttccgctaaatttcatatttcaccgttatttaactgtttatttcttgttaatgtaattggaaaagagatttaaaacatatgagttaataaattctaagttcatgacttgcctagcttctacgagtaggtgtcatcacgacgcccgagggtggaaaatccaggtcgtgacagttaggagcacctcccttcttgattccttttcgtgcgatttgataccttggggcttatgcctttgtttccttcctactcaatcttacgcggcgcgaaccgcttgttataaatcgagaattgaagaattgtaatagtactacagatgtggtgcgggatgtttctcccggtatagttggttgggcaattgtcgtcgccctgcggaaggatttttctatcgttttggctcggtagttgtgcctctaagagctcggaggctatgcccaggttgctatgatgctcacgattggttatcgcacaatattgaattgatggtaagatacttgcctctgtgttggggtggtgaatgatttgaaaggaattctactcagtgcacgattccgagatctgatatttcatttccagcggaggaaaagtaattggccgatgaatgtccagattcggggtgatggagtaacaagacttggtattttcgagcgcggtgcaattttcatctgcgatttagtgtcgtcgtcctcgattgtatgtgttaagtttgccggtgttatggtcttctgcaattcgcctttggggtaagatattgtgaaataatattggagaaacaacttttagatatcgcgggtgcggtggttcaggattgaataatgttgatggctcgagaaaggtgatctttggaaaggtttaaagttagtagcgatttgtgggttcaagtgctacgaagatagattttatttaaggcaacaactgagcagcaaaggatgaggaaggacatgtggggagtgtcaggcggtggttaaaatttgtagaaggccaggtataagaagcaaatgtcgagtagtcgattaaagggttgagttccgccaaagtgggagagtggcagagttgcatatgggctttgtggtaggatgactacgcaccttaaggagagtttggaatgatttcggaattttagtgatgggtgattggggtctacgaatttaatttgaggtatgggctattaggctgcaggagatttgatataacggaaaggaactgcttgaaatgaagaaggatacaacatacctttgaattggaatgatattgccgcacatttaattaatgtccacgaggggtgaaggaacttgtgcagctagagagtgagctcggactcaggataggttattgatgtcgtagtggttgtaccccgtgcagcagcgttggaagatgtcggcacgtaaattccacatgtgggttatctctagtgagcagattggcggtcgcatggttggcgaagcttctgcgaagaattctattagttatatagcaaagagatcggtcatgcgaatgtggttgatgattcaaaatataaaaagggggtcttacagaaagattctgagaattttggcgattgattgcgcaaggttatgtcaataagagataaagaatcctggtgaattacagagttgtgtaacagtagcttcaagctaagtgggagagtcccaccgcctatgatggggttgcatggttaactacttgcgaggtttctagttattagcaaattgatgggttattttagctacgggacaagaacataagtggtaatttgagcaaaggaattgttaaagttgtgctatggttggccttatcggctcatgttcagacttggggaaggattcgggatttatgccttgtatagatacggggttcaagagaagtgattctgccgggcgcttcgctgagagggtattcatgtgctagaagattcagggagtcgattatattcgaggccaagtcagtggattcaaaggggtaaagtgtggtgcctaataatttcgagcctataggtacggttaagaatcaagctttgtagtagcttatgagaagaggcccacaatgttctatgatgttttgacttgcagggtagcatttgggagttatgaaatgatttgtgggatttgagacagcatggtctcgtgattcaaggtcactcgggatgagtgcggatggagtgtgttatgtgttgaatggagttattattatttctaaggcaatcaggataaattggaagaagatagattgactagccgtagttgaatttgtatattggtggtagtggacagttctttcagcgtgatcaagttatgcaagtgatttgtgacggtatgtgtgaggcttgtcggccgccgtaattgatgttattcagaagtattctactgttatggcctgttatgtgtaggcagatcccgagagggctatggtggcttagaccactacttagagatttgcatattctacggtatgagaattcacctgtgtgttgctacggttcttctgaagtgagttaagtgaaaagtttttatatgatgaagtgttagtcttagtggttctggagttatgataaaagtcgtgttctatcgtatattggcatgttgggtgcagtgagtggtatggaatttgaagtgaggatcaaggttgcagttcggtgttgacaaggatgtcacgagctcggatgagaaggaaagaagtttggatgtttaaagtaagttggtattttattcagcgttacctgagatcggtgttttgtgaaaaaaggtttttcatcctggttaaggaatcttgatctcttttcagcgttagtgcggccggtggtttggatgtacatacctgttatctgttacggaaggttgtgggagcgtgccccacatgaaggttgtatatgtgtggcaggtagccactttattgattgaagagttaaaccaagtatgaatactgaagtgatgtcattaaactgagaattgatgcctagaaggcactcgatttattgggttgtagactgtggaggattactccagttatgatggttgttcctgtgtgttatgaggaaaaggggagttattatggacctttgaaatgttactagcctggtttagtgcggtcagaatacgcttgaggtctgtggatggatttaaatatgggctctatatcaagccaaatatgttcatttcagcaatgcgctccttatggaagggtagtcggggtgttattttgttgtcagttatttcacgtaatgatatattgcgtcgtgtgagttgtgtgatggcttggtgaatttcttatgtgttgaggttccgcgtagagatgatgttatatgagcagaatggctcttgtgattcagatcatatatcgcacctcagttgtgcttgagttttgtagcttatggcgctatatgtctccccagatatggtattatgcacttagcgtgcttgtgaccgacattcgttattttgttgtaataagcaatctggctcggtatgtatctccttatgtaaattttatgtgtggatcgggtggcacgctggcatgggtatgatgtttggatcgggttgcgcgccgcaacagtgtgatgttgagtacagttccccgtatttgttttatgtgttttgtttcctatttttctgaggaaagctcatattagctgtgtgcccacatcgcatgtatgattcgcgagcggggtgtctgtttagttatgttgatcgcgtcgcatgtatgattcgcgagcggggtaattggatttcctttttagagttcgttttccttttgtatcgcgttcgaattggtagcctattggcgcattgtggcatcatatgagacttttggtcatgtctgggtggcttattgcctgagcaggtcgaactgggtgagacgagatcatttgatttaggatcagtgcaatctgattatatgaagtatattaaggagctaagaccattatttggttcaaaatgaggttatggttcttgtcagaagtatacactacaaaaaaaatctcaattgccaacgaattttaccaaccaacggaatttgttagtatattagcaacaaattactaacaaaatcgtaactgatttatttttcagaatttagtaacatattcctaataaattgccaaccaaaagtttactaacggaataatttagttggtaaatatggcgggaaaaattggcggctaatctagcaaccgctactaacggattaccaactgaaatattaccaacaaacacttttcgttggtaatattaccaacggagtacgtatccgttggtaaatatggtagaaaaaatgaaatatagtttattaacagattggtaacgaattaccaaccaattatttaccaacacaagaattttgttgctaattttactaaccaatttaaaatgcgttagtaaattaccaaccgaatagtatatgttagtaaactttccaacggatactaaatcggttggaaatctttactaacagattaagattgtggtttgtaatttattaacagattaaaattagttattaatattacttacattatgtagacaataaattgcgtcgagaaaataaaatcaagaccgagaaatcactacaagaaagtatataatttgcaacaactttttaccaacaacttgctaaatatcaatgaatggcaacaactctatttagttgttgctatatcatatatagaaattttgcccacaaaaagtttcttgttagctaacgttttaattttgttgccataacttttggggtaatataacaattctaaaatataaataaattggcaacgataaattatcactgttgccaaaagtatttacttgttggtaaaatacttaattttctcaacaatttatttgacttgtggcctaaagaatatttagtctttctcaattttcaacaaaaaaaaaagcggcaaacttcccccccttttttcactcccgaatccctcccctttttattttcatatttgctttcactttccccaattcgttcagcccttccactcgtgctttgagataagaggttcaaatgagcgacaaccttatcttccagtgttgcggcaatggcttgaaatggtaagctccttcatctctagttttagttgtttctagtttaaggtttcaattccttgaatgattcaatttaggtttttaattaggaggtcctaaacagggttgacaactttctcaaagcaaaaactagggcttcaaattaaccttctactgtgttctatgagaaagttctcctccttgcttgggggtaagattccacgacttttagcttttttgttgttcaaaatttccatgtttagacatcgctatcagtgtcttcctagacgttaattgctactatttatacttgttgatcttatagtgctatattttgaaagaagaggatgagttaagtctacaagtcatgctaagtaactttatgcttcatgaaaaagtacatatttcagctttcttgatctgataattttgcaacttatattaagctttcttttagctgaatgtttttattaattcaacaattctataatatgtaaaattttcattgatgaagtattttttttggttttattaagtggacattatgcatatcttattccctcttttctttgttaatcgagctttatactttacaatttccttttatcaaaatgtaattatatttttcttcttttgtaggatgaatatgcttagatcatcattgctggaaatatggtccctgcggtgcaacaagttgttggaagaagatttatttttaggattaattagattagaacttaatggccttggtatatgatgattttgttctctttgtaaataaaagcatacattttaggagatttagtttttgaaagtgtatcaattttatgtattgacatatatatatatatatatatatatatatatatatatatatatataatttattattttatcaattgtggtgataatttatggttggctagtttaacggcaacattgaatatcttcacgacctacgataagaacgggatggtgatacaatcatactaactaagactagaagaagatttttagcgactaaaatcaaggataaattggctacaccagagagatgcaaatacaaaaaatttccacctaattacccttcaatggaggagaagaaatagaatcactgccctcgaagacttaggtggaaattgggtcacggagcaaccactagttgactccctaataatgagttagtacgactcactatttaccactactcacacacaatctactattaaaataataaaccgcgatagtaacactcttacaaatactgaccatttctatttgtcaagacctttatctataaaggaaatataccaaaccgttcagtccttccagcctctcaaagcaccagggccagatggacttcatccctatttttaccaataatattagcctcaaatctctacatctgtcgtctaatttttgccgacggtatcaccttaacatcaaacataactacttcaattgtgcacaccataatagatacactaacaaccttcatccaaaagtctggccaaagtataaatttccaaaaatagaaaatctatttttctaaaatcacttccccatcagacaaacactttgtcttatcatcttttaacatgagggaaggtaccaactttagtaagtacttgggattccccttgtttgtaaagcgacccacttaaaaaattaattttatactggataaaatagtaatttaattatttttctaatatttaggaatagttttaattcatccctaatatttaggacttcaaaatcaattaaaaattgtgtactaaatcctttcttatttgagctatgtaatataacatataggtaaaaaaaaaactaaaaaaatagctccggaaaaacacaatattttgtacgcttcgtctgcatgtaaaaacctttgatggaagactttcaattcctaaagttatattaggaaaagtatgagcactttggaatccataacattcaatccttttacttaggagtttttttttaatatacgtttggctaaaagaaagggaggacgagggtgtgaattggaaaggaaaaaaaacatgtaccaaattatttctcttggataaaatatatataaaatttatttctattatattgcaaggccaaaaaatagtaaatgccattcatattttaccccttaaaaataacttttacaatggacaaatttgtaattaactggttagtttcccaatgtttaggattttaaaattaattaaaattttggatattaaatctttccctattaaaataggtaggaagtactaatatttaagaatttaaaatcaataaataatttagcttatataaattgaactaatagacaatacatcctttgtgcaatacgtataaaatcaagatgagaacgatggcgacttcaattatactaattaaaaaataaaaaaatggagacataaaatcacatacattaaattaaaattatttaatacagtaacttctaagtaaaattatttcaatgtagaataattaaatatgtattttaaatattcttatttaatcatataaagtaattaattcatgttcaattaagcacctaaaataattattcaatatcatatttaagtataaaaaattatacaagcataaattcatttatatttatactatattaaaagcacgaagcccttatcgaaatatcgttcgccttttttatcctttaaaaattaatttcaaaccaaacaaaatagttatttaattatttttcgaatatttaggacttcaaaatcaactaaaattttatttaagaagaccttaatatctaggtcttcaaattcaattaaaatttaccttattatttttttttcttattttgaccagtttttataaatatccttttggagtttagtacgtgaccattaaagtttttttaattcttagcctctaaggtatataatagtttttattttttctcgctttttcttgttaaatttttgagagttttcatttaatcataactttaaatttctagaagtctgaactaatatggtgttaatttagaaataaattaagttatcgccatattatgtgaatgtgacaactattgttaatattttaaacctaagttaaactaatgtatttggaactcttgaaataactataaattagtcacccccttcacccccttataatttttaaaaattgacctcaacattgtgaatttttgaaatttcaaaattgttgttagcagaatgcattcggagtgagtttaggatggtattgactattatttgatattggatgaacgtgcaagaaaataaatttagacttaaatcaataagaatccaggcaacttttttttacacaagaagaggttcatttggctataattttgattaactttgaaagaagaactatttttttctataatgatattatgaatgtaaagtttacaaagagatcctggatgagatataacaacataacatatttgtatctaatataataaaatatttatagttataaatactatagaattaattacaccaaattcactcgaaaaatgttgaattcagctatatattatatcaatgtagtaacatctttttcatcatttgaacatatattgcatttagttttaccttcgttgctattttttaataatttatatacattttatattgattaacgtaatatacacgtgcaacgcacgtacactaaaactagtattataaagaaagtataatacatggtaaaattattatataaaaaggtagggtaaatgataaaataaaattatttaataataatgaagggtgaaattgagagaaaaatataaggtaacgacgcgatcacaccaaatcggtcattatataaagtgacatatttcgtcgttatgtaacgacatatttaacgatacgataagatacaattttagtaacaataaaaaaaatattgtatttaatgtaacaatacgatacaatataataggtacaaccatccaaacaagctgtaaattatttgtggacttagtttatattttgtaatttaaacatgaatgcaattatttttttatttttttatacacatagtttggtgcaattaaaatttattattttatatgataatttaataactaaagatacttgtatatgccatgtgacttgtgacgacccgacccgtcgtctcttgtatttcagccccgttatctccgttttatgtttccccgagtgttattatacgtgtttggtgagtttgaagtgatttgggttgaaattggatagaaatgagacaaatagtctctttaaggaaaacttaagttgaaaaagtcaacccgacgttgacttatgagttagagggctcggaatggatttccgatggctcgactagtttcgggggatgatttgtgacttaggagtgaaaacggaagtgaattcggaggttcggtgtgaaagttagcttggtttggcgaagttggaatttcggagaaatccggttgataggtgagaatttgatccgagggtcggaataaaattccgaaagttgcagtagcttcgttaggtgaatttggatatgtgtgcaaattttcaggtcattcggacttcgtttggttggtttcggcatcggatatgatttagttaagttcatgtttaacttagagttgaatttgaggattttggtaatttttggtgtttacgttagcgtttttatggcccgagcaagtttgaatgaggtattaggtcgaggttgtgcttttgggcgaggtcccgggggcctcggggtgatttcggagggttgtcggaggagtagcgccgttttccatagtgacccaaaaataaacggcagactacctaatctccaatttatgtaaattgctccatttttccacaagaaaaattgtcacgaccctagttcaccgaccgtgaacatgtcatgatggcacctggccggcgaggccaggtaagcctaactcattgcggaatacaacattctcataaggtaagacaataacaactggaataatataaaatgtaataggtgccgcccggcacatacatttaacatcatagaaacttcctaaaaatcatcccaaaacccggaaactcacgggcaagacacaggctaagataataagtacaatagctctaaacatacagaagtctaatacaagagagagaaagtacataaataactatagtcagtctatggatagaatagaaggaggactcgtaggatctgcggacgcggcagatgtatacctcaagtctcctagacagctgctccggactcactactgaaatgccgtgccggaagtacctggatctgcacatgggaaacatgcgcagaagaggcatgagtacaccacagcggtacttagtaagtgccaagcctaacctcggttgggtagtgacgaggaaggtcgatgccctactgagataataacaatataatcgatatgaaatgaatagacaatatgaaaacagtaatatcgaataccaaacaggataataagtaaagacggagaaacaggatcaatacaatatatgaacgaaacaaggcaagttcactacgaactatctatctttggggatctcctggtatcccgaggatctctccagtatcctcatttaacacgagggatctctccagtatcccgaggatctctccagtatcctcattaacacgagggatctctccagtatcccgaggatctctccagtatcctccatctatacacaggtatctccaagtattcctaggatctccacagtatccttcttttatactcatttacgtgccagggatctctttgtatccgcacttccaatcttagaacatagtaagtacaagaaattacgcgtaaactcctcatagcagttcaacataacaagagttaagagaaaacacggataaaactagagcttaacgtgcttcaccaacatcaaatattgcagtttaatcaagtaatcaagtaagtcaactagcatgcttttcctaagctaaaacaggtagaacttgcattttaggacagacattttaaaggaagaacacagtctaaatatttcaagtaaggtgagttccaacaatttgcacaagtacacgcccgtcacctcgcgcacaaggcatttaaagcaacagtcatgatatcctaaggggaagaggtcccccacacaaggttaggcaagtcacttacctcgaaccggtaccaaatcaataggaagcaaagcccttgccacgagtatccaactccgaatggcccgattctattcaagccagttactatatataaatcacaacgcaattaactaattacactaataaaattgaagctacgacgcgaaaataggtaaaatgaccaaaacgcccctcaggccaacgtctcggaatcagaatattttaatattttcagaaacctcgcgctctcacgagtctaaccatataaaatttatcaaaatcggaggtcaaatggtccctcaaaaacccaatcgatttggctaagaactctaacccatttcctccatttttggacctcaatttgaatttagaaagtggattaagcaattagatgatagattaaagctagaaatgatcaaagaaacgttacccaataatctcctctccaaaatcctctaaaaatcgccttggtccgagctctcaattgatttttcaacttatgaaattaaaccctcggacaaactcatattctctgcgatttccgcttgtgcggcacctgggaccgctcctgcggttccgcttaggcggaaaaacaaccgcaaggcggtttcctgaagttcctcagaggtcgcttatgcgaccaaaaagaccgcttaggcggtcccgcttctgcgacctgggttccgcttaggcgatccctgaccgcttaggcggtcctttgtccgcttatgcggactcgcctgtgcggctcaatttccgcttaagcagttatgacagaggactgctgcaattttctttccaactctccgttgagcatccgaaacacacccgaggcccccgggacctcaaccaaaccttcaaacataacccataacaacattcggtcttgcaccaaaccttaaatcacctagaacaacaccggaaacatgatttaatcattgaattgatcctaaaacttccaaagcttaaccaaaatcctaactgatgccgaaactaaccaaacgaggtccgaatgacctgaaaatttgcacatacatcccaaatcacctaacgaagctactaccgatctcggaattccattccgagcctcggatcaaattctcacctatcaaccggatatttcaaatttccaactttcggcatttcttggctaattgagctacggacatccaaaatacaatccggacacgctcccaaccccgaaatcacctaacggagctaacggaaccatcagatttccattccgaggttgtcttgacactgctccgacaacggaccactttccaacacttagactctcaattaaggactatttgtccaaaaacactccgaattcaactaccgaacatcccggcaaaccaaaatagcataaatagacccaggggaaacagttaaagggggtatggggcgcaaattctaaaaacgaccggtcgggtcattacaaaaatacagtagcttagatatacaatcaagtagcaccggcccctcatccaaaaaggagaggcatttgattttctgtagccgagttcgaggtgccgatttggtccatgtttgttgattcatgtttctcgttgctgtttgtttcaaatcatgtgtcacggattcactcgagtcggcttcaattgttgtaatcactgaatgttccgttaattgcaaagctttaaaattcagattcggcaataataaagctgttgaggatgagatttgtttgggttttatccgcgagcaaggtcataaaatcctccattgttggatattttggagagcttttggagcaaaacgaagagggaatcaaagaggattgattagaggtaagttttatggactcaaaacatcatttaatcatggtttttgcccttaaatttctgaaatcaaatcaaattggggaagaactagggcttgaaatttcaaatgaagatttgcgatttggaggagcaattggactccgattttgatgaactttatatgtacggactcgtggcgagacgaggattccgaaaatgtaagtttcataattttctgagaagcgggataggggctcaggtttttctagtttcgagatttttgctatttctcgattgttttcgattgggtattatcccattggcatattgtgatgtattcgctctattttttattagtttcgacgtgcgaggaggccgaattgtaaggcaaaggcgtcgcgagcttgagattttgccgattcgaggtgagtaatgggtgtagatgattacctgagggttcgaaaccccggtatatcacattgtgacgctattatgagttgagacacgcactccatggctagtgcgggttagtatgtgttgtgaattgtgactcggttcatcctgagggagaattatactatatatctattgcatcgcacaccgtattggtaatatctgggcttgatgccatgtttggggccttgtgccgacttgtataatccttcagggattgattgatagctgggcttgatgccatgtttggggccttgtgccgacttgtgtaatccttcagggattgatatatctgcatcatcatgacatgcatattatttgattacagtccaaaggttttaaacactgttttgaaaactcagccacagttatattttttgaaaacgtaaaggacttttaaatgatattttgggctgacgatcactatcttactatttctggactgtgcatggatcgggttgcacgtaccgcagcagtattgtgatatatggcgcttgggctgtaggagtgcctctggagtctgaacccccatagtgagcgcgggtacccaaatggagcgggctgcacgtaccgcagcggtcatgcattgcattgcattcatacattactctgttactttatttggatatatttgaggcttgtactgtatagaactgtttaactagcttcgctctgtgctttattgaggatttcttctttcgggtttatatatatgcttattactcactgagttggagactcactccatactccctgcaccttgtgtgtagattcaggtgctcctgaggcatagtgttgttgttactactgattatcggatagacggagacttgaggtggctgccagcgtccgcaggacccacttctccgatcctttgtctatcttccagtctttcagacattgtatctttcacattccagatttgtacactatttttggtagaggctcagtactcgtgacccttgattttgggaaatattgtgacatcttctgtttctttcatattgtcttggccctgactgggcggttggagatataaactgtgatttgaatatgtaaatctcttcttgttgggctgtaatgccgttgttgggttgttgtggtcgggcttgcctagccttgcggccgggcgccatcgcgaccgggatttgggtcgtgacaacttggtatcagagcctaggttgctaggtctcacgagttatgagccggtttagtagagtcttgtggatcggtacgtagacgtccgtatcatatccacgggaggctacagaactttaggaaacacttcacattcttggaattcttatcgtgcgtccttgattcagcttgaaagagtaactcttgaaattccttcctcacgtttgtatgcgcccgtgagcgcccagtattatatgtgccttgatggctgatgattccccgatcgaggggtgagttatgacttctatgagttgatgttgggccagtctggaggacttgaggccgaatttttgtctatggcttgagcacgaggtgctgattctacgagctagtattatgagcttctatgtccagtattgtccttaattgtggtaatggcggctgaatagcttcatgatgagtacgttggtgccgtgtgatgtgtttgtatgactcggtagtgtcgaaaaaggtctgctagatgttaaataaaccattaagtgtttgatttccgttgcgatcgaatatgttgccccgagttaggggtgcgtgaagaatcttttcgagtctcctagctgggagtgaagcggattgcgtgttgcagtatgagttcaggctcaggaagactaagtaatcgtatgaggtgtatgacggtggatgatgtaccgagatattatattgaagcaagcaggtgggtatctcctgcggattattctgaagtggtatgattgtcatgtgtatgttagaagatcttatgtgtaattaaaaaggtatattctatatgttatgattcaaacaggtgcaacgcatgttcatgtgtcaattttgataaaataatgcgtgtatcattgagatttctattattgatatacattgtgatgttttgtcaacttgtggacgtgttgttaggatggtttggtggttttctggcaggtggataggcttaattacaaaggaaactctgccaaaatttttggaaaatctaggacttagtaaaaaatttgtcgccttaagaagtgggcttaacggttgtgtgaatgaatgcaagaattgcagaagagttagaatttttgatgattcgtggttccacaagctgatgaaagagtgagtttaatctcgccatgatgttacgatggttaaagagtatgtgtgttttaaaatatatatatggcttcgagctaagttggggaggtcgctgtggatgagctggtggtacggttatgtactgtgctagtttcgatttgatgcatgtgtgtgaatcagttctagctgcagaaagtgagccgagggtggcacaagtgaagcaaaattttgccaaagattatgtggtacttcgtgggtgtgagaaaataagggaatgtcttgagttattgataaaagaatggttagcgtaaagggaaggaaattgtttggttgtatcggggtgagatcacgtccggtgatgtcagagtgctgataaggcccgagtggttcgattcattaagtcaagtaatttgcagtgggtataagagtggttaacttctgagaatggttttgatgtgttcaggattctataagtgtcactcaggtgttttaaggttgcgtgtgtggtcagagacagtgtgtgcattggagatgtcaagacttgtggtatttttaagctaactatgggactctatgtatcagtatcaggaaggtaaagaaagcaatgttaggttcgcaggaagttcgttagagaaaggcattctgaaatgcgggtgctattgggaatatgtgaaagagtatatagtgaattatggatttcagacagtgtggtttatgtgtagatctcatgtggtaagtatgggttgaaggattggggtactacagctaaaggaaataacgaattgaagatggatcaaaaggaaatttgtttgaggggtagtgtgatcacggaccggattcggcatgttaagggtatgcttagttctcgttgtgtattcgaagtaatgggttagcacatgtaatttttgtgcagcaatgctcttgggtgtgacaattctctctgtgtgtcgtaatttaaaaggattcagtcatggcagtttagttgtgcagatgggattaggagagttcttgttgaattatacatggttgaagagatgcattttctacggatgtgagatggcatgaggtgtataataatctttcttctaaatgggatcaatggaagttctagactagctgagagcgtcgatgtctgcggcgcagtagggagatgaaagttctcgtgatatcctgggaggatatggtatatgcgggatgttgtaaaggcctgagatgggcatagtgcggggtttcggttcagttctgaaacgtatggcgggttagttaagtcttacatgacgagtagcttcaggtaatcaaggaaatggtgctattaattggaagtgatttggcgatggcatatgtttctgaaagagggtgatctcacaagggatacatcagtagtgttacggcagtttcttatgagatcgactgcggatatctgagttgtttgatggcatgggagttttaaaatatctctcgtgggatagttgggtacttgtggggtaaagttttctggagttctccggtgtagtctatatagtggttgtggatcgtgtgtgtgctgtattggtactgttagcggctattgggaattcggaagccgagtggatctttcctggcttagtatgttaaattctggatatgatatggggacgtagagtgactttctcagtgtcggattattctaaacaattgtgctatgagtcatgaggggaattgccacaggttgcgtggcggggagtatcggactaagttctagctggatggttgtgttccagagactagcggtcggctgggaagaattgcgttccttaattgggcctttgaggcggatgtcagtatagaggtttctaccattgatttcggttccagtattgagggacttttcagatgcgtccttatggccgggcatgtcgcctggcgagactgtggatttcggtaattatttggtgccgggcaccatatcgtacggctccgttatgagttatagtagtgaaaagtggtatttacagcttacaacgcttatatgtatatctttatgcacctagttgcttcgaccgatgtaggtattttgttattgtgagcaaatttggctcgatgtgcaactccctatgtgaggtacgtggtatggatcgagtggcaggctgccacgagtatgttatctggatcgggttgcgcaccgcaacagtgtgatgtcgagaatagctttccatgtggtgatttgtattctttgcttcctggtttccgagggaagtccgtattgagagttgctcggcgaatagcgtatcggttgtgtcctttcaggatggaatagtgtatattacttgtttcaccgtgagtgtgatggattacttggttttaggcatcgatctgtgcatggcggtctactctgagcatggtagaatgaggtgcttcatgtgtagcagtgttgagttaggatcgcgtgttgtggcaaggccacgtgaagttatgacctctcgaggaggattcaggtactctattcctatgatgtgagacggggtctcagctttgttttgtaaaggtattgatgagctcgatatatgactcttttcccggttgagtcatttgtcctgattggggtgtgtgtagactgtttcttattggcgcgtgtatcatgcaaattgtggcttaggcctgtgttgaggtaccatatcaccggaagtggtgtgttagattcgaggtgatcatttggttattaatgagtatgagcagatttgatttcaactggttagaaggataatatcgaggtttgacccaaaaatctgttgtggtaatagtcaacatggaagtgacttcatgaatgattgatatgaagaactgctactgctcgttgcgggttttaattatcgttggcagtatgcgaaagtgttggaataagactttagctaaataaggggttatctattggtaatgagtattgtgggcaattgctgtgaatagagactatcgtgccgagtgttggaatgtggtgtataatgtatgaattcaccgaggttgcaggtgtgggttgttaaagctggttcgggttaattctgagtatagatgtaaagctctgatttggtgtatgatttcggaaaatgcaatgtgattctgcggtttatgggccagatggattgtgaaatttcggctgtgttgtgttatcggcacatatgtgagttagggtgacgtgggatcaccccgggcatatacttgctaatgtcatttggctattggatacgctcgagtacagctctgggtacgctcgaggacgagcgttcgtttaagttggggagaatgtgacgacccgacccgtcgtctcttgtatttcagccccgttatctccgttttatgtttccccgagtgttattatacgtttttggtgagtttgaagtgatttgggttgaaattggatagaaatgagacaaatagtctctttaaggaaaacttatgttggaaaagtcaacccgacgttgacttatgagttagagggctcggaatggatttccgatggctcgactagtttcgggggatgatttgtgacttaggagtgaaaacggaagtgaattcggaggtccggtgtgaaagttagctttgtttggcgaagttggaatttcggagaaatccggttgataggtgagaatttgatccgagggtcggaatgaaattccgaaagttgcagtagcttcgttaggttaatttggatatgtgtgcaaattttcaggtcattcggacttcgtttggttggtttcggcatcggatatgatttagttaagttcatgtttaacttagagttgaatttgatgattttggtaatttttggtgtttacgttagcgtttttatggcccgagcaagtttgaatgaggtattaggtcgaggttgtgcttttgggcgaggtcccgggggcctcggggtgatttcggagggttgtcggaggagtagcgccgttttccatagtgacccaaaaataaacggcagactacctaatctccaatttatgtaaattgctccatttttccacaagaaaaatacagtagcttagatatacaatcaagtagcaccggcccctcatccaaaaaggagaggcatttgattttctgtagccgagttcgaggtgccgatttggtccaagtttgttgattcatgtttctcgttgctgtttgtttcaaatcatgtgtcacggattcactcgagtcgacttcaattgttgtaatcactgaatgttccgttaattgcaaagctttaaaattcagattcggcaataataaagctgttgaggatgagatttgtttgggttttatccgcgagcaaggtcataaaatcctccattgttggatattttggagagcttttggagcaaaacgaagaggaaatcgaagaggattgattagaggtaagttttatggactcaaaacatcatttaatcatggtttttgaccttaaatttctgtaatcaaatcaaattggggaagaactagggcttgaaatttcaaatgaagatttgcgatttggaggagcaattggactccgattttgatgaactttatatgtacggactcgtggcgagacgaggattccgaaaatgtaagtttcataatttttcgagaggcgggccaagggctcaggttttgctagtttcgagatttttgctatttctcgattgttttcgattgggtattatcccattggcatattgtgatgtattcgctctgttttttattagtttcgacgcgtgaggaggccgaattgtgagtcaaaggcgtcgcgagcttgagatttcgccggttcgaggtgagtaatgggtgtagatgattacccgagggttcgaaaccccggtatatcacattgtgacgctattatgagttgagacacgcactccatggctagtgcgggttagtatgtgttgtgaattgtgactcagttcatcccgagggagaattatactatatatctattgcatcgcacaccgtattggtaatagctgggcttgatgccatgtttggggccttgtgccgacttgtataatccttcagggattgattgatagctgggcttgatgccatgtttggggccttgtgccgacttgtgtaatccttcagggattgatatatctgcatcatcatgacatgcatattatttgattacagtccaaaggttttaaacacagttttgaaaactcagccacagttatatgttttgaaaacgtaaaggacttttaaatgatattttgggctgacgatcactatcttactatttctggactgtgcatggatcgggctgcacgtaccgcagcagtattgtgatatatggcgcttgggctgtaggagcccctccggagtctgaacccccacagtgagcgcgggtacccaaatggagcgggctgcatgtaccgcagcggtcatgcattgcattgcattcatacattactctgttactttatttggatatatttgaggcttgtactgtatagaactgtttaactagtttcgctctgtgctttattgcggatttcttctttagggtttttatatatgcttattactcactgagttggagactcaccccatactccctgcaccttgtgtgtagattcaggtgctcctgaggcatagtgttgttgttactgctgattatcggatagacggagacttgaggtggctgccagcgtccgcaggacccacttctccgatcctttgtctttcttccagtctttcagacattgtatctttcacattccagatttgtacactgtttttggtagaggctcagtactcgtgacccttgattttgggaaatattgtgacatcttctgtttctttcatattgtcttggccctgactgggcggttggagatataaactgtgatttgaatatgtaaatctcttcttgttgggctgtaatgccgttgttgggttgttgtggtcgggcttgcctagccttgcggccgggcgccatcgcgaccgggatttgggtcgtgacaacttggtatcagagcctaggttgctaggtctcacgagttatgagccggtttagtagagtcttgtggatcggtacgtagacgtccgtatcatatccacgggaggctacagaactttaggaaacacttcacattcttggaattcttatcgtgcgtccttgattcagcttgaaagagtaactcttgaaattccttcctcacgtttgtatgcgcccgtgagcgcccagtattatatgtgccttgatggctgatgattccccgatcgaggggcgagttatgacttctatgagttgatgttgggccagtctggaggacttgaggccgaatttctgtctatggcttgagcacgaggtgctgattctatgagctagtattatgagcttctatgtccagtattgtccttaattatggtaatggcggctgaatagctttatgatgagtacgttggtgccgtgtgatgtgtttgtatgactcggtagtgtcgaaaaaggtctgctagatgttaaataaaccattaagtgtttgatttccgttgcgatcgaatgtgttgccccgagttaggggtgcgtgaagaatcttttcgagtctcctagctgggagtgaagcggattgcgtgttgcagtatgagttcaggctcaggaagactaagtaatcgtatgaggtgtatgacggtggatgatgtaccgagatattatattgaagcaagcaggtgggtatctcctgcggattattctgaagtggtatgatcgtcatgtgtgtgttagaagatcttatgtgtaattaaaaaggtatattctatatgttatgattcaaacaggtgcaacgcatattcatgtgtcaattttgataaaataatgcgtgtagcattgagatttctgttattgatatacattgtgatgttttgtcaacttgtggacgtgttgttaggatggtttggtggttttctggcaggtggataggcttaattacaaaggaaactctgccaaaagttttggaaaatctgggacttagtaaaaaatttgtcgccttaagaagtgggcttaacggttgtgtgaatgaatgcaagaattgcagatgagttagaatttttgatgattcgtggttccacaagctgatgaaagagtgagtttaatctcgccatgatgttacgatggttaaagagtatgcgtgttttaaaatatatatatggcttcgagctaagttggggaggtcgctgtggatgagctggtggtacggttatgtactgtgctagtttcgatttgatgcatgtgtgtgaatcagttctagctgcagaaagtgagccgagggtggcacaagtgaagcaaaattttgccaaagattatgtggtacttcgtgggtgtgagaaaataagggaatgtcttgagttattgataaaagaatggttagcgtaaagggaaggaaattgtttggttgtatcggggtgagatcacgtccggtgatgtcagagtgctgataaggcccgagtggtttgattcataaagtcaagtaatttgcagtgggtataagagtggttaacttctgagaatggttttgatgtgttcaggattctataagtgtcactcaggtgttttaaggttgcgtgtgttgttagagacagtgtgtgcattggagatgtcaagacttgtggtatttttaagctaactatgggactctatgtatcagtatcaggaaggtaaagaaagcaatgttaggttcgcaggaagttcgttagagaaaggcattctgaaatgcgggtgctattgggaatatgtgaaagagtatctagtgaattatggatttcagacagtgtggtttatgtgtagatctcatgtggtaagtatgggttgaaggattggggtactacagctaaaggaaataacgaattgaagacggatcaaaaggaaatttgtttgaggggtagcgtgatcacggaccggattcggcatgttaagggtatgcttagttctcgttgtgtattcgaagtaatgggttagcacatgtaatttttgtgcagcaatgctcttgggtgtgacgattctctctgtgtgtcgtaatttaaaaggattcagtcatggaagtttagttgtgcagatgggattgggagagttcttgttgaattatacatggttgaagagatgcattttctacggatgtgagatggcatgaggtgtataataatctttcttctaaatgggattaatggaagttctagactagctgagagcgtcgatgtctgcggcgcagtagggagatgaaagttctcgtgatatcctgggaagatatggtatatgcgggatgttgtaaaggcctgagatgggcatagtgcggggtttcggttcagttctgaatcgtatggcgggttagttaagtcttaaatgacgagtagcttcaggtaatcaaggaaatggtgctgttaattggaagtgatttggcgatggcatatgtttctgaaagagggtgatctcacaagggatacatcagtagtgttacggcagtttcttatgagatcgactacggatatctgagttgtttgatggtatgggagttttaaaatatctctcgtgggatagttgggtacttgtggggtaaagttttctggagttctccagtgtagtctatatagtggttgtggatcgtgtgtgtgctgtattggtactgttagcggctattgggaattcggaagccgagtggatctttccttgctaagtatgttaaattctggatatgatatggggacgtagagtgactttctcagtgtcggattattctaaacgattgtgctatgagtcatgaggggaattgccacaggttgcgtggcggggagtatcggactaagttctagctggatggttgtgttccagagactagcagtcggctgggaagaattgcgttccttaattgggcctttgaggcggatgtcagtatagaggtttctaccattgatttcggttccagtattgagggacttttcagatgcgtccttatggccgggcatgtcgcctggcgagactgtggatttcggtaattatttggtgccgggcaccatatcgtacggctccgttatgagttatagtagtgaaaagtggtatttgtagcttacaacgcttatatgtatatctttatgcacctagttgcttcgaccgatgtgggtattttgttattgtgagcaaatttggctcgatgtgcaactccctatgtgaggtacgtggtatggatcgagtggcaggccgccacgagtatgttatctggatcaggttgcgcgccgcaacagtgtgatatcgagaatagctttccatgtggtgatttgtattctttgcttcctggtttccgagggaagtccgcattgagagttgctcggcaaatagcgtatcggttgtgtcctttcaggacggaatagtgtatattacttgtttcaccgtgagtgtgatggattacttggttttaggcatcgatctgtgcatggcggtctactctgagcatggtagaatgaggtgcttcatgtgtagcagtgttgagttaggatcgcgtgttgtggcaagggcacgtgaagttatgacctctcgaggaggattcaagtactctattcctatgatgtgagacggggtcttagctttgttttgtaaaggtattgatgagctcgatatatgactcttttcccggttgagtcatttgtcctgattggggtgtgtgtagactgtttcttattggcgcctgtatcatgcaaattgtggcttaggcctgtgttgaggtaccatatcaccggaagtggtgtgttagattcgaggtgatcattgggttattaatgagtatgagcagatttgatttcaactggttagaaggataatatcgaggtttgacccgaaaatctgttgtggtaatagtcaacatggaagtgacttcatgaatgattgatctgaagaactgctactgctcgttgcgggttttaattatcgttggcagtatgcgaaagtgttggaataagactttagctaaataaggggttatctattggtaatgagtattgtgggcaattgctgtgaatagagactatcgtgccgagtgttggaatgtggtgtataatgtatgaattcaccaaggttgcaggtgtgggttgttacagctggttcgggttaattctgagtatagatgtaaagctctgttttggtgtatgatttcggaaaatgcaatgtgattctgcggtttatgggccagatggattgtgaaattttggctgtgttgtgttatcggcacctatgtgagttagggtgacgtgggatcaccccgggcatatacctggtaatgtcatttggctattggattgcttctagtacagctctgggtacgctcgaggacgagcgttcgtttaagttggggagaatgtgacgacccgacccgtcgtctcttgtatttcagccccgttatctccgttttatgtttccccgagtgttattatacgtgtttggtgagtttgaagtgatttgggttgaaattggatagaaatgagacaaatagtctctttaaggaaaacttatgttggaaaagtcaacccgacgttgacttatgagttagagggatcggaatggatttccgatggctcgactagtttgggggatgatttgtgacataggagtgaaaacggaagtgaattcggaggtccggtgtgaatgttagcttggtttggcgaagttggaatttcggagaaatccggttgataggtgagaatttgattcgagggtcggaatgaaattccgaaagttgcagtagcttcgttaggtgaatttggatatgtgtgcgaattttcaggtcattcggacttcgtttggttggtttcggcatcggatatgatgtagttaagttcatgtttaacttagagctgaatttgatgattttggtaatttttggggtttacgttagcgtttttatggcccgagcaagtttgaatgaggtattaggtcgaggttgtgcttttgggcgaggtcccgggggcctcggggtgatttcggagggttgtcggaggagtagcgtcgttttccatagtgacccaaaaataaacggcagactacctaatctccaatttatgtaaattgctccatttttccacaagaaaaatacagtagcttagatatacaatcaagtagcaccggcccctcatccaaaaaggagaggcatttgattttctgtagccgagttcgaggtgccgatttggtccaagtttgttgattcatgtttctcgttgctgtttgtttcaaatcatgtgtcacggattcactcgagtcggcttcaattgttgtaatcactgaatgttccgttaattgcaaagctttaaaattcagattcggcaataataaagctgttgaggatgagatttgtttgggttttatccgcgagcaaggtcataaaatcctccattgttggatattttggagagcttttggagcaaaacgaagagggaatcgaagaggattgattagaagtaagttttatggactcaaaacatcatttaatcatggtttttgcccttaaatttttgaaatcaaatcaaattggggaagaactagggcttgaaatttcaaatgaagatttgcgatttggagaagcaattggactccgattttgatgaactttatatgtacggactcgtggcgagacgaggattccgaaaatgtaagtttcataattctttgagaagcgggccatgggctcaggttttgctagtttcgagatttttgttatttctcgattgttttcgattgggtattatcccattggcatattgtgatgtattcgctctattttttattagtttcgacgcgcgaggaggccgaattgtaaggcaaaggcgtcacgagcttgagatttcgccgattcgaggtgagtaatgggtgtagatgattatctgagggttcgaaaccccggtatatcacattgtgacgctattatgagttgagacacgcactccatggctagtgcgggttagtatgtgttgtgaattgtgactgggttcatcccgagggagaattatactatatatctattgcatcgcacaccgtattggtaatagctgggcttgatgacatgtttggggccttgtgccgacttgtataatccttcagggattgattgatagctgggcttgatgccatgtttggggccttgtgccgacttgtgtaatccttcagggattgatatatctgcatcatcatgacatgcatattatttgattacagtccaaaggttttaaacattgttttgaaaactcagccacagttatatgttttgaaaacgtaaaggacttttaaatgatattttgggctgacaatcactatcttactatttatggactgtgcatggattgggctgcacgtaccgcagcagtattgtgatatatggcgcttgggctgtaggagcccctccggagtctgaacccccacagtgagcgcgggtacccaaatggagcgggctgcacgtaccgcagcggtcatgcattgcattgcattcatacattactctgttactttatttggatatatttgaggcttgtactgtatagaactgtttaactagcttcgctctgtgctttattgaggatttcttctttcgggtttttatatatgcttattactcactgagttggagactcactccatactccctgcaccttgtgtgtagattcaggtgctcctgaggcatagtgttgttgttactactgattatcggatagacggagacttgaggtggctgccagcgtccgcaggacccacttctccgatcctttgtctttcttccagtctttcagacattgtatctttcacattccagatttgtacactatttttggtagaggctcagtactcgtgacccttgattttgggaaatattgtgacatcttctgtttctttcatattgtcttggccctgactgggcggttggagatataaactgtgatttgaatatgtaaatctcttcttgttgggctgtagtgccgttgttgggttgttgtggtcgggcttgcctagccttgcggccgggcgccatcgcgaccgggatttgggtcgtgacatgactagttactaataacatagtaggaagagtctaataaaataaaattactaaaatactcacaaaaaaaatggagaaagcgggaaatttcctaagaggcaaaaagaatgaagaaattaaataaaaagaagaagaaattaaataaaaagaagaagaaattaaataaaaagaagaagaaaataaagtatgccgccaaaacttttcccctgtctccaactcccgcgccatttcatcagtttcttctaccaacgatcacaatatgctaaatccttgcaattatttttcccaactgaaagattatctcaagcggcctctcatcacaagctatcgtttggattcttctggtcaattccacaatccattcggctaagtggtaagtctctcacaagctattatttggattcttctcaattccacaatccattggggtaagtggtaagtatttttttttatcaatcttatttttttagtatattgtagatatgttgatatgctatatttgtttggttatatatatattgaattagtatattttgtagttgatggcttatatagattaaagaaaacagagcagatacttcttgtgagcttcacttaattgttttttagtcctttgctattggcatgtaactatctctgccatttttttgctaaatatttgaaagcttgtgcttattatacggggatttgagacctaatttgattattagtactcttttttactgtccagagatttttagaaatcaataaatgctactgtaatccttttacattatcaggaaagaaagtttgtcagaaaaatgacttcaaatcgcgagtggatgtacagaaggctaacgagaggtttgtataatcccgaattcataagggatgttgagaaatttattgagttttcaaagaatcatcgtgaaggaagggatggtgagagactaaggtgcccatgtaaccgaaaaaagtgtcagaacagaaattttgaagatgttcttactgtccacgagcatttattgcgcgatggctttgtacctggatatcatatatggtacttgcatggagaaaatgaggttacgagaaatataaatcaacatgaagagatgcgaaattgggatcagtctatgaataccgaatcggtaaatgtgggtgcaattgatgagcctgaatcacctacttcataccacagaatggtccttgacgcatctggcccctcattcgatcagattgatagggatgaattaccgaatcctgatgcgcaaaaattttatgatctgatagattctgcaaatcaagaggtgtggcctggctgtgaaacacattctcaattgtcagctgttgcacgtttattgcacatcaagtctgaacaccatctatctgatagatgttttgatgacatttgtcaatatgtgaatgagatgattcctccggataacctaatgccaaataatttctatgaaactaagaagttaatgcagggaatgaacatgccagatgtaatgacccgacctgtcatttcttatgtttcagcccccttatccccatcatatgcttccctgtatgttgttatgcatgtttggtgaagttcgaagtggttcgggtggagtttggatagaaatgagaccaatagtctctttaaggaaaatttaagttggaaaattcaacccgatattgacttatgggttagagggctcggggtggatttcctatggctcgactagtttcgggggatgatttgtgacttaggagtgaaaacggaagtgaattcggaagtccggagtggaagttagctaggtttggcgaagttggaaattcggaagaatccggtcgataggtgagaatttgatccgagggtcggaatggaattccaaaagttgcattagcttcgttaggtgattttggatgtgtccgcaaattttcaggtcatttggacgtcgtttggatggtttcggcaccggagatggttttgttaagtttaagttaacttagagttgaatttaaggatttttggtggtttttgatgttaaagttagcatttttaaggtccgagcaagttcgaatgaagtattagggtgagttggtgcttttggttgaggtcccgggggcctcgggatgatttcggaggctaaacggatttagttttggtgttggaaagctgcagaaatgcagcagcagttgcaggcatttttatgccttcgcgatcgcgtgaggccttcgcgtttgcgtaggcctgggtcccgttggtcttcgcgttcgcgggtaatggatgcgttcgcgtagggtattggactggaggagaaagcccaggccatttggccttcgcgttcgcgagttgggcacgcgttcgcgatgagggaagggcagcttggctttgcgttcgcgagatgggctcgcgttcgcgtatgaggaatttcggcccagttaaaaatggtcttcgcggacgcgagtgggcatcgcgttcgcgtataaggagacgtctggggcagaatgttttaagttattatttcatccgcgagccttagcttatttcctccatttttgagcaaccttgagggctttttgacgagaatcgaagagggtttcacctgggattgattggaggtaagtctcttgaccttgaaacatcattttactgaggaatcacccattaattctctgaaaattgggcaagatattgaagaactagggcttgggttttgaaacttaaaatgatgatttgaaggagcaattggactccgatttcgataaattttatatgaatggactcgtggcgagacgagagtcattttggtataaagctttcttgttttcgagacgtgggctcggggctcgggttttgctactttcgcgaatttagttgtttttcgagttctttcgattaggttatgttccattagcattatgtaacgtattcgttgtggttttggccagattcgtcgctcggagaggtgaatttgaaggagaaaggcatttcgggctagttttccgaccggtttgaggtgagtaatgggtgtagataattatccgagggtccaaaaccccggtttatcacatggtgacgctattatgagctagacacgcactccagggtagtgcggggtcgtacgtgttgtgaaatatgactcggtcccaatccgagggataaatggtactgtgttagcgattgcttcgcttttccatattgatgatatctgggcttgatgccacgtttggggccttgtgccgacttgaggtatccttcagggatcgatatgaccgttctagcatgatttgcttaatatttgaactcagttctgtgtatcttcattgtgtttaacttgcacatatcatgatttcctgaagttatgtgacctgaacatggtttttattataaatgggatctaaaatctataagaaaaatggtttagtgactctcatgcatatcttgcactcatatggatcgggctgcacgtaccgtagcggtatatttatgaaatggatcgggctacacgtaccttagcggtgttgttatgatatggatcgggctgcacctaccgtagcgatattatgatatggcgcttgggttgtaggagcccctccggagtctgtacacacccccagtgagcgcgggtacccagatggatcgggctacacgtaccgtagcggacatatgcattgcattgcatagcattcatactcatattctctgttgcttatctgggtatatttggaactgttctgactgaaactgtgtagatagctttaccttgtgttttatctggatttcttactttcgggtctttatatgcatttattactcactgagttggtagactcaccccatactccctgcaccttgtgtgcagattcaggagctgctgagtcttagctgcagttgctgcggattccagatttttcccagagatttgaggtagctgcaggcgtccacaggacccacttactctgtcttatctagactattactttaccgttcttttcagactttgtattttctctatcagttgtaagcgttgtatccagaggctcatattcgtgaccccttggttttgggaacgtgatattgtttcagttgtctatattcagtattggccctgaccgggcggttatacattattctgttgtaaaattcttgaaattgtttcttgttgggctttaatgccgtctgttgggttgttgtggtcgggcttgcccagccttgcggccgggcgccatctcgaccggaatttggggtcgtgacaacttggtatcagagcctaggttgctaggcctcacgagttatgagccggtttagtagagtcttgtggatcggtacgtagacgtccgtatcatatccacgggaggctacagaaccttaggaaacacttcactttcttgaaattcttatcgtacgactttgctgagctgagaactgaatcttcttatttctattctctcgcagatggcgagaacccgtactacaggacgcggtggacgacccccagtggcacctgctagaggccgtgggcgtgaccgcggttgtggtcgtggtcgagttgggccagcagaggcagcacatgcagacccaccagctgatcagactcagggtcagcctccagcgggggatgtccccccagcaccggcagtacccattgtgatacctggtctccaggaaacattggctcagattctgaccgtctgcaccggcctagctcaggtcgtatcagcttctacagcagcagctacatctcagacagggggaggacatcagacccctgctgctcagactccagagcaggttgttcagggcttgcagacccctgaggcagcccctattgctccagttccacaggttgctccggttctgggggttatggttccggctatgccagaggacgagcagcgtcgtctcgaaatgtacagcagactttcgcctccggctttcagtggggcgcagggcgaggatgcccagggatttctcgacaagagtcgacgcatgctccagactgcaaggattttagagactagcggagtatcattcactaccttccagtttacgggtgcagcatttacatggtgggaggcatatgagcggcgtaggccggcaggagcagcaccgttgtcctggctagagttctccactctcttcctggagaagtgggtgccgcagtcgcagcgagaggagctgcgtaggcagtttgagtatcttcgacagggtgatatgacagtgtcacagtatgagatgagattttctgagttggctcggcatgctccatggatggtcccgactgattgggagaggatcaggagatttgtggacgggcttatctatcctgttcgtattttgatgtccagagagagggttctgacccattcctttgaggatgctgttgacattgctagggacattgaggcagatcaccgtctggagagagaggagagagaggccaagaggtctcatgggtctggtagtttcagcagtgctccgtctaggggtcagttccagcagggcagaggtcgccctttcaggcagcagcagccggcccgtcccgagtaccgcggggcgtcttcaggccgtggtcatcagggttcacagcagggtcagtcttcactgagtgcactccctgcacagggttcatcctatgctccttcagctcagggttcttcagcgcagagtggatcggcgggtcattctggtgcgaggggttcccttcagtccccttctccagctccaggcagttgttttgagtgtggtgagtttggccacataaggaagttctatcctcgattccggggtggtagatcttattctcagcagagggaccagccctcatcttcggcaccagtttcttctgctccccctcagccagctaggggaggtggtcaggcagctagaggtcgacccagaggtggaggccgtaccggcggtggtcaggccagattctatgctataccatatagggccgacgccgtcgcatctgatgctgttatcacaggtattattccagtctgtcaccgagatgcctctgttttatttgatccgggatccacctattcttatgtgtcatgctattttaccaatcatctaggtgtggttcgtgattgtcttgtctcacctgtgcatatatctaccccggtgggtgatactatcgttgtggatcatgtgtatcgatcctgtgtgattatgtttgggggtctggagacccgtgttgacttattgttattaggcatggtggattttgatgtgattttgggtatggactggttgtccccataccatgctcttttagactgtcatgctaagacagttacattggctattcctggtgttcccagagttgagtggcgaggtgtgtctgattatgtacctagcagggtaatttctttcttaaaggcccagcggatggttgggagaggttgtttatcttacttggcttttgttagagatgtcggagctgagactcccagtcttgattcggttcccgttgttagggacttccctgatgtgtttccagcggacctgccgggcatgccgtcggacagggatattgatttcgatattgatttggtgccgggcacgcagcccatttctatcccaccttatcgcatggcacctgcagagcttaaggaattgaaagatcagcttcaggaactcctagaaaaggggtttatccgtcctagtgtgtcaccgtggggtgcacctgtgttatttgtgaagaagaaggatggcaccatgaggatgtgtattgactacaggcagttgaataaagtgaccgtgaagaataagtacccatttcctcgtattgaggatttggttgaccagctccagggagctaaggttttctctaagattgatctttgttctggctatcatcagctgaagattcgggattctgatattatgaaaacagctttcaggacgagatataggcattacgagtttctggttatgtcgtttgggttgactaatgccccaactgcattcatgcacttgatgaatagcgtgttcaggccgtatctggattcgtttgtgatcgtgtttaatgatgacatcctggtgtactcgcgtagccaggaggagcacgcacagcatttgagggttgtattgcagaggctaagagaggagaagctttatgctaagttctccaagtgtgagttctggcttagttctgtggcattttttgggcatgtagtatccagtgatggtattctggtggatccaaagaaagtggaggcagtgcagagttggcctaggctgtcttcggccactgagattcggagtttccttggcttggcgggatattaccgccggttcgttgagggtttttcatctattgcgtcgccattaactaaattgacgcagaagaatgctccatttgtttggtctgatgagtgcgaagagagctttcagaagctcaagtcagcattgactacggctccagtgttagtattgccagcagcttcaggttcttatacggtatattgtgatgtttcgaggattggtattggatgtgttcttatgcaggagggtagagtgattgcatatgcttctcggcagctgaagccacatgagaagaactaccctgttcatgacttagagttggcagctattgtgcatgctttgaagatttggaggcactatctctatggcgtatcttgtgaggtgtatacagatcatcgcagccttcagcacttatttaagcagaaagatctaaatttgagacagcggaggtggcttaagttactcaaagactatgatattaccattttgtatcacccggggaaggccaatgtagtggccgatgccttgagtcgaaaggcggttagcatgggcagtttggcgttcattccagttggggagagaccccttggagtcgatgttcaggccttagctaatcggatggttcggttggatatttcggagcctagccgggtgttggctagcgtggtttctcagtcttccttgtatgaccgtattagagagcatcagtataatgaccggcatttgcttgttcttagagatcgggtccagcgcggcgatgccagggatgtgactattgatagtgatggcgtcctgaagatgcagggccgtatctgtgtgcccaatgtagatggtattcgggagatgatattggcggaggctcacagctcgcgatactccattcatccgggggtcgcgaagatgtatcaggatttgagacagctctattggtggagaagaatgaaaaaggacattatgagtcatgtagctcggtgtctcaattatcagcagatgaagtccgagcatcagagacctagtggtttgcttcagcagatggttattcccgagtggaaatgggaaaggatcacgatggattttgtgactggtctccctcggacagcgaggaagtttgattctatatgggtgatcgtggatcaactgaccaagtccgcgcacttcattccagtatgtacctcatattcttcgcagcggctggcagagatctttattcgtgagattgtccgattgcatggtgttccggtttctattgtatcagacagaggtccccagttcacttcccagttttggagggcttttcatcgagagatgggtactcaggtcgatttgagttcagcatttcatcctcagacggacgggcagtccgagcgcacaattcagatattggaggatatgttgcgtgcttgtgtgattgactttggtggttcttgggaggatttcctaccccttgcagagtttgcttacaataacagctaccagtctagtattcagatggcgctatatgaggctttgtatgggagacggtgtagatctccggtgggttggttcgagcccggcgaggctatattgttgggtacagaggtggtccaggatgttttggagaaggtgaagatgattcaggagcgacttcgtacagctcagtcgcgtcagaagagctatgcagatcggagagttcgagatttatccttcatggttggcgagaaggttctgctgaaggtttcgcctatgaaaggcgttatgaggtttggaaagaaaggaaagttgagtcctcgtttcataggtccttttgagatacttggtaagattggggaggtggcctatcagcttgcattgccaccccgattgtcgggagttcatccggtgtttcatttttctatgctccggaagtatgttgaagacccgtcccatgttttggacttcagctcgattcagctagatgatgatttgacctatgatgtggagccagttgccattttgggtcgtcaggttcgcaagttgagatctaaagaaatagcatcggtgaaggttcagtggagaggttgtcccgtggaggaggctacttgggagaccgagcaggagatgcggagcagataccctcacttgtttactgcttcaggtatgtttcttgacccgctcgaggacgagcgtttgttttagttggggaggatgtaatgacccgacctgtcatttcttatgtttcagccccgttatccccgtcatatgcttccctgtatgttgttatgcatgtttggtgaagttcgaagtggttcgggtggagtttggatagaaatgagaccaatagtctctttaaggaaaacttaagttggaaaagtcaacccgacgttgacttatgggttagagggctcggggtggatttctgatggctcgactagttttgggggatgatttgtgacttaggagtgaaaacgaaagtgaattcggaggtccggagttgaagttagctaggtttggcgaagttggaaattcggaagaatccggtcgataggtgagaatttgatccgagggtcggaatggaattctgaaagttgcattagcttcgttaggtgattttggatgtgtccacaaattttcaggtcatttggacgtcgtttggatagtttcggcaccggagatggttttgttaagtttacgttaacttagagttgaatttaaggatttttggtggtttttgatgttaaagttagcgtttttaaggtccgagcaagttcgaatgaagtattagggtgagttggtgcttttggttgaggtcccgggggcctcgggatgatttcggatgctaaacggatttagttttggtgttggaaagctgcagaaatgcagcagcagttgcagacatctttatgccttcgcgatcgcgtgaggccttcgcgttcgcgtaggcctgggtccccttggtcttcgcgttcgcaggtaatggacgcgttcgcgtagggtattggactggaggagaaagcccaggccatttggccttcgcgttcgcgagttgggcacgcgttcgcgatgagggaagggcagcttggcttcgcgttcgcgagatgggctcgcgttcgcgtatgaggaatttcggcccagttaaaaatggtcttcgcggacgcgactgggcatcgcgttcgcgtataaggagacgtctggggcagaatgttttatgttattatttcatccgcgagccttagcttatttcctctattttttagcaaccttgagggctttttgacgagaatcgaagaggttttcacctgggattgattggaggtaagtctcttgaccttgaaacatcattttactgaggaatcacccattaattctctgaaaattgggcaagatattgaagaactaaggcttgggttttgaaacataaaatgatgatttggaggagcaattgaacttcgatttcgataaattttatatgaatggactcgtggcaagacgagagtcgttttggtataaagctttctagttttcgagacgtgggcccggggctcgagttttgctactttcgcgaatttagttgtttttcgagttctttcgattgggttatgttccattagcattatgtaacgtctttgttgtggttttggccagattcgtcgctcggagaggtgaatttgaaggagaaaggcatttcgggctagttttccggccggtttgaggtgagtaatgggtgtagataattgtccgagggttcgaaacccctgtttatcacatggtgatgctattgtgagctagacatgcactccaaggtagtgtggggtcgtacgtgttgtgaaatatgactcggtcccaatccgagggataaatggtactgtgttagcgattgcttcgcttttccatattgatgatatctgggcttgataccacgtttggggccttgtgccgatttgaggtatccttcagggatcgatatgaccgtactagcatgatttgcttaatatttgaactcagttctgtgtatcttcattgtgtttaacttgcacagatcatgatttcctgaagttatgtgatctgaacatggttttcattataaatgggatctaaaatctataagaaaaatggtttagtgactctcatgcatatcttgcactcatatggatcgggctacacgtaccgtagcggtatatttatgaaatggatcaggctacacgtaccgtagcggtgttgttatgatatggatcgggctgcacgtaccgtagcgatattatgatatggcgcttgggctgtaggagcccctccggagtctgtacacacccccagtgagcgcgggtacccagattgatcgggctacatgtaccgtagcggaccgggcggttatacattattctgttgtgaaattcttgaaattgtttcttgttgggctttaatgccgtctgttgggttgttgtggtcgggctttcctagccttgcggccgggcgccatcgcgaccgggatttggggtcgtgacaccagtagaaaaaatccacagttgtgtaaatgcctgtatgatttattggggagaagacagtgaacttagccattgcaagttttgtcgccatcccaggtacaagcctactaggcaaatatcgaattcaaagagaaatcttgtaccattcaaacatatgtactactttcccctcactccacgattacaacggttatatgcttccgacatgactgttgcatatatgcgatggcatgccgagcatgaagttgaggaaggtgtgatgcgtcactgttcagatgcgcccgcatggaaacactttgataagatgcatccatcttttgcagctgaaagtcgtaatgtcaggttggggctatgcacagatggttttcaaccatttggacaaacaggtcaacaatattcatcttggccaatagttgtgacaccatacaacttgccgccttggatgtgtatgaaagagtcctatttgtttttgtcggttatagttcctggaccgaagaaccctaagcaaaagcttgatgttttcttgcagcctttgattgcagaactaaaacatttgtggagtaccggtgtggacacatatgatatctctaagaagcaaaattttaacatgcgagctgctttgatgtagacagttagtgattttcctgcatattcgatgttgtctggatggggtactgcgggtaagctagcttgtccatattgtatggagaatacagatgcttttactttgactaaaggtggcaaacagtcatagtttgataatcatcgtaagttcctaccactggatcatccatacagaaataacagaaattcatttagaaagaataaagtggtcagaacgcatcctcccccgatacggtcaggtgatgatatattgaaggagataaatgaattggggttgaaaaaggtgacagagcttggggctgatattgttaatggcaaaattagtaagttttcgggttggaagaaaagaagcatattttgggatttgccgtattggagtacaaatctgatccgacacaatctagatgttatgcacatcgaaaaaaactttttcgagaatgtgttcaacacagtgctggacgtagatggtaaaacaaaagataatgccaaatctagagaagacttgaaagagttctgccgacgccctgaattacatgctgttggtgacgaatatccgaaagcttgttatacactagacaagaagtccaaaaaagtgttgtgtgaatgggtggagaatctgaaattttcagatggatatgtctcaaatatgggaaggtgtgtggacatgaaaaaacataaattgtttggtatgaaaagccacgattgtcatgtattcatgcaaagattggtccctattgcgtttcgtgagctattaccacaaaaagtttgggaaccacttgctgagatgagccttttctttagggatctcacttcaacagcaattcgggaagaggatatggttaaacttgaacaagaaatacctgaaattctttgtaaattggagcgtatattccctcccagcttctttgattcaatggagcatctccccgtgcatcttgcttacgaagcaaggatagcaggtccggtgcaatatcgatggatgtacccatttgagaggtaaaatttcatctttctgcttgtatatttatagttgctgtttagttgtatctttatagttgctgccctgcatagttgctgccctgcatagttgctgtttatagttctatctttatagttgctgtttatacttgtatctttatagttgctgccctgcatccaaaactagattagttacctcaatttgctgctgtccagatttgatagttgttgttgttcgataagtagcagctggattagttaccacaatcctaataatttcttgcctttgctccatattaacaccatcatcatctgccttgtttcctaattgtgttggtgcattagctcgatcgactgatcctgctttagctgtcatagcagttgcttctttggtagaattcaacctgtcataagcttgaactataggattaactgcaatttagctgctctccttgggtgatatcagtgctttttgcgtaagcagaatatggcagtgtttaggaggttctcaacttcaatttagcttctccaagtttgtctaaaccaagtggttcttttccttgtatggagttgcttagcctcaatttagatgaggggtgggagtacgcctcgtcggttctattttaatagttctcaaacaataaaaatctttttgggggttaagaacattaacggattagtgtttgataccttcaggaatttggacagatgttagatgcttgggtgttgtaatagctacctagaatgctcttaacagagaggaaaaaggggatagtcaagattggattggttcatacataagtaaggagaaatctattacagctaaaatatacatgatgcttaatccagcaggcaagacatggagccgaacttcttgctcaagattctgatcaacatatgtaattatgttaatattgattacatgattcaggaaatattgttgacaaaccatctgacatactctttacagacacctgcatctcatgctaactacgcagctgtcatagactgtttggtccaggaagccatgaagctatttgggattttaaatactcccttgcatccccttgcaacttttcaaaatttgtaacatccttaataggcagaacactgtccagattcacctcctctgtcgtcacctctgtttcagcttgtgttttcattaatcgacataccttttcgtcatgtccttgatgtttgcaacaagtgtaatacttaggcagattgtaatatactatctcctgatagtgcacgacctgtttaccagtaacacgatcaacaatctgaagcttaacctttttaggatgtttaccaagaagatcaattacaaccttaactgtagcagcactagttctagttttttcttgtgtcgccttatccaccgcaagagctttaccaacaactgacgcaatagacattaacgacctctttgcaaaaaaattaggtggcaaacctggtagagaaatccatacaatagccatcgatgtctcttctttcggattgaatcctagcgtccatgagaaagttcgaaagaaatagtcgtcgcctttgaatttaagatatccagtcgaccttgacaaaaactaaacataatcagtggatagacaggtggaagcaacccaagctgcagcattaaaataaacaatacattcagtagcatgttccaaagctttttataggaaatacaaactgaacactgcttataccattgtctgagtcagtcttggatctaaattttgcaagagagaggcagctggattaaccattccaatgttcaaatgtgttgcaggagaggctacaagggcaggaccaatagcacctgctggaggatgaaaatgtaccaagtcaaagagaattagtagttgactctaggcattaaattttttatgttaagtatttgaataatgcccgtagctgaaatttcgtttataggcttttctcaattgtttagattaaactgaaatctagtgagcgtttttaaattcaatgacactgatgagtactactgtatcatttttttataagggtggtgtcatggcctgctttcaagcaccttgactattccatcggatgcctgcatcctccgaaatagtcgtcgcctttgaatttaagatatccaatcgaccttgacaaaaactgaacataatcagtgtataaatcaaacctgatcaacatgtgacgaaatttcaattgccccacgttacagtgtcacgtcgaattgcgacgcaaaaattcttctgatttcttgtttttccataagagaatttcatcactactgcctgatgtagcccttccagagagaggagagagcgtagagagctttttttttcttctttttctgcttgtatctatttactgccctaggtcaaattcatgcctttatttatttgtttcaattgatatgaacagaatacaacattgatatgattgactcacaatttgagcatatgtgttatttccaggaaccttcggaaattgaaaaataatgttcgaaataaggcacaagttgaaggatccatatgcaatgcgtatttagttgaggaagcttcatctttttgttcacactactttgaacctcatgtttacacaaggcataggaaagttccacggaatgatgatggtggtacaagggaaagggatgagcgcgatggtaatctttctatatttacctatccaggtaaagcatttaggagatgtaaatcaagatatatgactgaagaagaacttgatgcagctcatatttatgttttattaaattgcccagaagtacacccatatattgagtaagacttcaagcttttgttttcatttgtagattagcaaaatcatcaaaaccttaatatgatattttcttggatgtgattcaaaggatttttattgactcccttcgtcaaaatttcccacaaattacggagaaggaagtggataagaaacttgatgaagattttgcatcatggtttaaaagatatgtgagtacttgtacaatatccttccacttatacttacctcacttatgagaaactctaattatttttcttttataggcaagggtccatatagataatcagttcatcaaggcccttgcagaaggtccgtgtcgaacagcacaaccatggactggttatacagtcaacggctttaaatttcacactaaaagccgcagttcttctagatcatctaacaacagcggtgtatgcataaaaggaactaattatagtgcagatgatagtgactactatggcgtgctaactgatatccttgaattggagtacaagggtagtgagtatataaagagaactattttatttaagtgcgagtggtttgatcccacaccaaaggcaggaatgaagattcacccacaatataaacttgtggatatcaaccatgaaaagaagttaaagaagtatgaaccatttgttttggcaatgcaagcggctcaagtgtattatacaacttatcctagcttacgacgtgataagagtgagtggtgggctgtgtgcaaagtaaaagcacggggtttggtggacatgcctccgtcatcttcacagtcaactccgacagatggtgttgagccattccaatatgaggaagatggtttaacatttgatgtggtacctaataataaaattattctcctgaatgatccaaatggtggattcataaacataagagacgaggatgatgatttagatgatgaggtagaacttcatgttgaatttggatcggacgaagatgaggataaggatgaggataatgaggatgaagagctatatgatgaaaatgacagtgaatagagtcaaagtgcttcaatctcttcaattatagagtctgaatgaatgaaacatagtatataatttatttttattttttagtttttaagaaaaagttcctagatttcagattttatgggttcttgttttttttaacttaagtaaatttgttcctttttagatgtttgtcttttgaaatactttataaagtaaatttgttcctttttagatgtttgtcttttgaatctgccatgtctagattaatacttgtatgccttatttttttcagagcattttgttcttggagtaatgtatcatttaattactcttggaataatatatcaattcctgtatccaatcagatttgaccatgattcgttaattatgttatttgttcatctgcatctgactttggaatcgcagatatggcacctaggggaggtggagcacgtagatatgctgaaaacaggaatgcaaacacactgagatctcctgagatgttgagtcccacatctgatcagtcacctgaacctgatcagtcacctgaacctccagttacagaaacaccacatttggatgcaactataaacagatccttaccatcttcttcttctgatcttggtacacctgcagatgaaatccgatcagcaagttcgtcaaacacaattggcggtaaccgtatcccaattacaatcgtccttggagggtaagagtaaaagtgtcacttgtttatattttttttaatttttgtttcttgcttatctggtatgtatcagtgcatctcaaatgcttcttgaaagaatatgaaagccttaaatggaatggagtaacaacataattcgtttcttatttactttagccaactggacccgggcaatgacgtcgctcggtctgtcacaaaaatcttcaaggagaaactggatcctgaaggacataattggaagtctgttacaccagagacaaaatacttctattggaaagagtttaaggtaaagttatagtattataagatcgataatatttggagttcctttatctttcttgagccaaggatttactacactcgctataagttgttgttgttattgttatcaatatcttgtgttattttcatttgatcttctcaaacagaaacgatttcagtgggacactgcaattgaaggttctgtaaaggataagtttatgagcaaatgtgcagaacgatacaagggtatgttatctgaagcaagaagttgtgagaaaaagcgcaaaactattccagtatctatttgggacagctggaagcctcactgggagactgaggcttttaaagccaagtccgcgcaatgctcaaggaatcggctaagtgagaaaggtggtgaagggtctggtccctcacgccatacaggaggctccagaagtcaccgagaacatgcaagacaaatggtatattcctttttttattagccaagttataatatctccaaagctagtgattatgtattaatatagtgaacatggttttcaattctaggctaaagaactaggaagaccagctcatccacatgagcttctgaagaggacacatgtcaaggcgaacaaggagtttgtggaccagaaatctaagagcacttatgtaagttacttctcctatttttgctgtgacgtttgctactttgattgtgatggccattcagttttaacatatgtatctatagtattcagtgtcacaatttataggattagcacaaagcatgcaagatgttacttaagagtcaaagaattgatgataaatgaatgtcattttccagtggaaagcattcttctgattttgcgaatcttcaatattttgtctaagggtcccaactacaggttatatataccaccttttacttgctcaatattttgatatgtcttcacatgctgtttgttacgttctggcaactggttgtactagtgttgtaaatagcgctcgcctcagcgctaatagcgtgaggcgaggcgatgcgagctgccatcggtattttacagtgtggcgtagcattttcagcgagcgcctctgcctttgtagcgtgtggcgacatgtagcgtgaggcgacctgtagcgtccctttttgcaaaaaagaaaagaacaaggcagtagcagtgatctattaaaacaaaaaattagggctcgcgatttctttactctttctccttcaagtcgacatcaactattggtttaaagcatagtagaagacatgtatcaagatgatctccaaggcaaagtgaaactgatagttgtcttgtgactgtgacagaagtgattgagcctgaagttgcttctgctgcaaatgtccattttcagttacactagtcctttgtggacagttgaggtatctggtgaatgcgcaagacagattatatgatttcccatataactgttgtgttatggttgaacctccagtttgttgttgattgaaattgtgcactgattcagtgagatttgtttcctggaaggaggtgcaaatgttctgtattgctgttgggactggtggattagattgcactttagtgtacatgaactgtagaataacctgaagcaactggcacaatttcaacaagaatgagtatatagagtgctgataccacttattgaaactgcaccagttgtacaagtgtattccaaataccatgtgagaatgaaagctagataatagagcaatcaattaagaaggatccatcagctgagtgagtggttgcctgcccagttgagtaaataggggcagagttgttgtttgctggtggttgatgtgtctccagtgaacttctcctgttgttcttcttgtttgtagtctatttatatcatttagacctttatagtgcataaagcattactgtacctgtatttcttgagaaaacttttactacaattgttatcttttcaaactaaaatgaaaaggaactgaatccctttcttcttttcttacaagtaatagaaaaaagaacataaagtttaagcgtaaatgtgacgacccaaaggggtcagcacttcttttattagtcatttcgagcttctgaggccttgaaaacctcattattagttgcctcgattttcgtgcgtagtccgggcgcgaagccggaaaatttttatgttgaaatatatgaattatgtgaaaaatttgaagaattttgatattaatattgatatagttgacttcggtcaatattttgggtaaacggacccggaaccgtgatttgacggtctcagaaaatccgtagaaaaatatgggacttgggcgtatgcccggaatcgaattccgaggtcccaggcccaagatatgaatttttccgtgaaattgttttctgaaaatgtttaaggaaaatgaaaatgagatttgatcaaaaagtaatggtatcgggctcgtattttggttccgacgcccggtacatgtcatatatattgtttaagcgctatctgtaaagtttggtcgaaatcggacgtcgtttgacgtgtttcggaactaaatagctaagtttgaagctttgaagtttaaaatggaaaataaggattttaaggtttaattcgttgttttttatgttattttggcgatttgatcgcacgagcaagttcgtaggatatttttgagtgagtatgcatatctagtttggagccccgagggctcgggtgagtttcggataggtgtcggagtgtttttgaacttagaaaatctggtatttttgctgtctgttgttgccctaccagataaatcatagatcaaataatcaagtttgatatctagttggcttttatattttttaatttatttctttcattgcttgatctttctattatcagtgttttgcttggttcatagtgagaattttgaaaactcaaggtcaaaagttttttcttttatggcttaaaggaataaattccaagcatttggaactgtcatgatttactctaagattagcgcataatggtattaagtagtttgcttttcctttctgcctctacttctcaagattctgtccttctcttttctttagagatgagatatttctaggactttttttattagtactataagggcagactacccttatagtaaggtctgcgtacacactacccttttactgggtcgtcgttgttggagcagagccaagaatcaactgtttgtagtttacctggacttgggacataaattgcctggctattatgtctgatttacatgcaaccttgaggtttgctcagctgaattttctggtggttaagcattgatgttgggtcaacgactcaataaaacactatctggtacaaagatgtggtgctataacctataggtagacaataaaacactatctcgtacaaagctgtggtgctatagcctataggtagacaataaatagatgcatatttttggtgttcatcttgtttctagacagcaaaaatctggtatttttgttgtctgctgttgccctaccagattttctaagttcaaaaacactctgacacctatctgaaactcacccgagccctcggggctccaaaccagacatgcatactcactcaaaaatatcctacgaacttgctcgtgcgatcaaatcgccaaaataacatcaaaaacaacgaattaaaccttaaaatccttattttccattttaaacttcaaagcttcaaacttagctatttaggtccgaaacacgtcaaacgacgtcccatttcgaccaaactttacagatagcgcttaaacaatatatatgacctgtaccgggcatcgtaaccaaaatacgagcccgataccattactttttgatcaaatctcattttcattttccttaaacattttcagaaaacaatttcacgaaaaaattcatatcttgggcctgggacctcggaattcgattccgggcatacgtccaagtcccatatttttctacggattttccgagaccgtcaaatcatggttccgggtccgtttacccaaaatattgaccgaagtcaactatatcaatattaatataaaaattcttaaaatttttcacataattcatatatttcaacataaaaattttccggcttcgcgcccggactgcgcacgcaaatcgaggcaactaatattgaggttgatgtgacgacccgacccgtcgtctcttgtatttccgtcccattatccccgttttatgctcttcatgtgttattatatgtgtttggagagtttgaagtgtttcggattgagtttggttagagatgaggcaaatagtctctttaaggaaagcttaagttggaaaagtcaaccggacgttgactattgagttagagggcgcggaacggatttccgatggctcgactagtttcgggggatgatttgtgacttgtgtgtgaaaacggaagtgaattcggaggtccggagtgaaagttagctagatttggcgaagttggaatttcggaagaatccggttgataggtgagaatttgatccgagggtcgaaatggaattccgaaagttgcattagcttcgttaggtgattttggatgtgtctgcaaattttcaggtcaatcggacatcgtttggttggttttggcaccggagatgaatttggaaagtttaagttcaagttagaattgaattcaatggttttggtgaattttgatgttaaagatagcatttttatgattcgagcaagtttgaatgaagtaacaagtcatgttggtgcttttggttgaggccccggatgtctcgggatggtttcgaatggttgaacggggtgtttggagttgttgttgagctgctgaaatgcagcagctgttgcaggcaaaagttgccctatgcgatcgcggggctgttgatgggatcgcatagaagggctagtgagggtcctgagttttgttcaatgcggtcgcgtatctagggttgcgatcgcataggttgtgtttgatgttctctgcgatcgcagaggtctttgtgcgatcgcgtaaggttacatggtcaggtccttgtcagagggattgttctatgcgaacgcatggtctatgatacgaacgcggaggttgaggtttggactctatgcgatcgcagggagctgaacgcgatcgcataggaggaatcagaggggtgctaaatttgttctctacgatcgcaagccaagggctgcgatcgcgtataaggatttacctgggcagagaagcttttatttcatatttcatccgcgaccaagcttgtatttccaccatttttgaagaccttgagagctctttggtgcaaattgaagagggattcgaagagggttgatcggaggtgagttttatgaattcaaaacatcatttaatcatggatttagcccttaaatttctgaaatcaaatcaaattggggaagaactagggcttggaatttcaaatgaagattggggatttggaggagcagatggactccgattttgatgaacttgatatgtacggactcgtggcgagatgaggattccgaaaatgtaagtttcgtaattttttgagaagcgagcccggggctcgggttttgctagtttcgagattttggctatttcttggttgttttcgattgggtattgtcccattggcactttgtgatgtattcgctctgtttttgcttagattcgacgcgcgaagaggccggattgagaggcaaaggtgtcgcgggcttgagatttcgccggttcgaggtgagtaatgctagtaaatgttgttctgagggtttgaaaccccggactttcacatcgtaacgctatattgaggcgtgactcgcactcccggatatgtgcggagtcggatattgttggggattgtgacttggtccatcccgagagagattctatggtatactagcgtatgatacgcacactgtgatgattattattgggctatatgccgtgtttggggcctagtgccgacctgtgacatccttcgggagttgacatttctgtttatcatgatcgcatatcatttcatatcagtccatggcttttaaaatattgttttcaaaacccagccgtatttctaatgttcaaaaactcgcatgctatctttaaatgtatttcggctgaggatcatgacttataactgcccaagtggcttgtgatatattttctggactgattttgggtggctcgggctgcacgccgcagcagtaatataatcggccaggtaacatggactggcctggtattgattattcgccacgagatggctgtccgccgtgggccctttgtaggtagatccggtgagactttgcattgtattcgtccgccgtgggccctttgtgggtagatccgatgagactgggattgtatttgtccgccgtgggccctatgtgggtagatccggtgagacttattgatttttgccaccacgagatggcttgatattgcgcttgggctgtaggagcccctccggagtctgtatacacccccagtgagcgccgtcgacgataaatgatatggttggctcggactgcacgtcgcagtgggtactggattgtaccaacatttgcattgcatagcatccctgcatttgcacctaatatatttattgttcagttgttctgatattgtggtattctgttatttagcttactttgtgcatttactgtgttttcttatcttcggagcttcatttattattattactcactgggtcggagtactcacattactccctgtaccttgtgtgcagatccagggcatgctcaggcggattagatcctgcagcttttcagacatcagcagttcggagcgttgaggtagctgcacggtgttcgcagccatcgaccctccttccctctatctttatttcctgtttttcttgtgtactttcagttgcaaccagatttgtatcagattgagttgtcatcctagaggctcagacttgtgacacctgttcctaggggatttgctattggtttcagtttctttccgctctgtctttttatatataaatctcttcagtgttgatactattatttctttattgtaattatctgggattattgagattgtggtcgggcttgcctagccttacggccgggcgccatcgcgaccgggtttgggtcgtgacaacttggtatcagagcctaggttacttggtctcgcgagtcatgagccggtttagtagagtcttgtggatcggtgcgtagacgtccgtaccatatccatgggaggctatagaactttaggaaacaattcacattcttggaattcttatcgtgcgtacttgattcagcttgaaagagtaactctcgaaattcttttcctcacgtttgtatgcgcccgtgagcgcccagtattatatgtgccttgatggctgatgatccccgatcgaggggtgagtattgatttctatgagttgatgttgggccagtctggaggacttgaggccgaatccttgcccatagctggagcaccaaggtgctgatcgcgcgagctagtgttttgaacttatatgttcggtgttgtccctattagtggaaatgatgggtggatagcttcatgatgattacgttggtgctgtgtgatgtgcttgtatgacttaggagtgtgcgtgtggaggtatgagtccagactcaggaaggctaattgattgcgtgaagtgtgtgacggtgaaggatgtaccgaaatgttatattgaagcaagaaggtgggtatctcctgcagactattctggaatggtataaccattatgtggatgattgaaggtcttatgtgtaattaaaaggtagtttcctatatgttatgattcgaacaggtgcaacgcatgttcatgtgtcagttttgataaaataatgcatgtagtattgagatttatattgttgatatacattgtgatgtcttgacaagtggtggacgtgttgttaggatgggttggtgattctctgacaggtggataggcttaattacaaaggaaactctgccgaaatttttggaaaatttgagacttagaaaaaaaaaaattgtcaccttaagagtgggcttaacggttgtgtgaatgaatgcaaaaagttaaaggaaagttagaatttctggtgaatcgtgtttccacaaacctatgggagagtgagtttgatcccgccatgatgttatgatggctatagagtatgtgtgttttaatatatgtggcttcgagcttagttggggaggttgctgttgaatggctggttgtacggttatggttatgtactatgattagttccgatttgatgcatgtgtgtgaatcagttctagctacagaaagtgagccgagggtggcacaagtgaagcggaaatttggccaaagattgtatggtacttcgtgggtgtgagacaataagggaatgtcttgagttattgatagagagaatgcttagcgtaaaggaaaggaagttgttcggttgtatcgaaatgagatcatgttctgtggtgtcggagtgtcgataaggcacgaggggttcgattcgttaagtcaggtaatttgcagtaggcataagagtggaggacttttgagaagggtttcgatgtgttcaagaatctatatgtatcactcaggtgttctaaggttgagtacgcgatctagtcagtgttttcattggaacaagtcaagacttatggtatttttatgctaattgcgagattctatgtatcggtattcgggatgaagtggcgactaaatcagagtcgcaggaagttcttcgggtaaagtactttggaaatgtggtatctctgagaacgtttgagaaggtatccagtggcctaagggtcttagacagtgtggtctggtgttcgggtctcgtatagtgagcctgggttgaggcattatggtactacggcaagagggtgtaacaagttgaaaaggaaccaggtgggaatctaggcaaataaagtaacttgttagtggaccaaatcggtatggtaagggtgtgattggttctcgttgtgtatttggggtaatggtttagcacgggaaatttttgcagcaatgctcttggatgttgatgattcccttggtgtgttgtaattaaaaggggctcagtcatggcagcgtagttgtgccgatggaaatttgggagagttctggtggattaatacatgatttaagaggtgcattttctacggatgtgaaatggcatgagatgtatgatgattttcttctaaatgcgatcaatgaaagttccagactagttgagtgcgtcgatgtctgcggcgcagaagagagatgaaagttctcgtgttatccttggaggatattgtgtatgcggtatattgtaaaggaccgagatgggcatgtgcgaactctcgactcagttatgaaaggtatggtggaatggatatgtcttaggtaatgaatggcttcaggtaatcaagagaattggtactgttaattggaagtgatttgttgatggaatatgtttcggaaagagggtaatctcacaaatgatacatcaatagtgttacggcattttcttctgggatttctccggtgcagtctatgtagcggttatggatcgcgggtgttgtgtcggtactgtcagcggctattgggagatttgaatccggatggatctttccttgcttaatatattaaattctggatatgatatggggatgtagagtgattgcctcagtgttggattattcgactcgattgtgctatgagtcatcttgggaaatgccacaggttgcgtggcgaggtgtatcggactatgttccagctggatagttgtgttccagaggctagcggtcggctgggaagtattgcgttccttaattgggtcttcgaggcggatgtcggcatagaggtttctaccatcgattgcggttccggtattgagggacttctcaggtacgtcctagtggccgggcatgtcgccgggcgagactgtggatttcggtagttatctggtgtcaggcaccatatcgtacggcttcatcatgagttatagtagtgaaagtggaatcttgtagcttgcaatgcttttatgtatatctttatgcactcagttgcttcgaccaatgtgggtattttgtcattgtgagcaaattttgctcgatgtgcacctccctgtgtgaggtggttgtgtagatcgggtggcactccgccacgggtatgttatctggatagggttgcgcgccgcaacagtgtgatgttgagaacagttttccatgtggtgatgtgtattctttgcttcctggctttcgaggaagtccgtattgaaattgctggcgaatagcgtttcggttgtgtcctttcaggacggaatggtgtatattacttatttcaccgtgagtgtgatgggttacttgattttaggcattgataggtgcatggctgtcggctttgagcatggtagcatgaggtgtttcatgtgtaacaatgttgggataggatcgcgcgttgtggcgaggccacgtgaagttatgacctctcgaggaggattcaggtactttatttctatgatatgagacggggtctcagctttgttttgtaaagggatggatgagtttgtggtataactcttccggtagtgtcattcgccctgacttgggtatgtgtagactgtttcttttggcgcatgtattatgcaaattgtggcttaggcctatatcgaggcatcatatcaccagcagtggcgtgtcagattcgaggtgatcattgggttattatgagaatgagcagattggaattcagctggttagaaggataatatcgtggttcgacccgaaaatccgttgtggtaatagtcaactgggaagtgacttcatgaatggttgatctgaagaactgctacagttcattgcgtgttttagttatcattggcagtatatgatagtgctggaataagactttagctaaataagaggtgttctattggtaactgaatgttatgggcagctgctgtgaatagaggctatcgttccgagtgttggaaggtgtggtatattgcatgaattcacctgagggttgcaggtgtgggttatgacagctggttcggattaattctgagtatagaggtgcttttctgatcttgtgtatgatttcaaaagtgcagtggggttctacggcttatgggtcagatggaatgtgaaatttcagttgcgatgtattttcggtacctatatgagttagggtgacgtgggatcacccgggtatatgtctggtatcgtcatttgggtattgggttgcttctagtacagctctgggtacgctcgaggacgagcgtttgtttaagttggggaggatgtgacgatccgacctgtcgtctcttgtatttccatcccattatccccgttttatgctcttcatgtgttattatatgtgtttggagagtttgaagtgtttcggattgagtttggttagagatgaggcaaatagtctctttaaggaaagcttaagttggaaaagtcaactggacgttgactattgagttagagggcgcggaacggatttccgatggctcgactagtttcgggggatgatttgtgacttgtgtgtgaaaacggaagtgaattcggaggtccggagtgaaagttagctagatttggcgaagttggaatttcggaagaatccggttgataggtgagaatttgatccgagggtcggaatggaattccgaaagttgcattagcttcgttaggtgattttggatgtgtctgcaaattttcaggtcaatcggacatcgtttggttggttttggcaccggagatgaatttggaaagtttaagttcaagttagaattgaattcaatgattttggtgaattttgatgttaaagatagcatttttatgattcgagcaagtttgaatgatgtaacaagtcatgttggtgcttttggttgaggccccgggggcctcgggatggtttcgaatggttgaacggggtgtttggagttgttgttgagctgctgaaatgcagcagctgttgcaggcaaaagttgccctatgcgatcgcggggctgttgatgggatcgcatagaagggctggtgagggtcctgagttttgttcaatgcggtcgcgtatctggggttgcgatcgcataggttgtgtttgatgttctctgcgatcgcagaggtctttgtgcgatcgcgtaaggttacatggtcaggtccttgtcagagggattgttctatgcgaacgcatggtctatgatgcgaacgcggaggttgaggtttcgactctatgcgatcgcagggagatgaacgcgatcgcataggaggaatcagaggggtgctaaatttgttctctgcgatcgcaagccaagggctgcgatcgcgtataaggatttacctgggcagagaagcttttatttcatatttcatccgcgaccaagcttgtatttccaacatttttgaagaccttgagagctctttggtgcaaattgaagagggattcgaagagggttgatcggaggtgagttttatgaattcaaaacatcatttaatcatggatttagcccttaaatttctgaaatcaaatcaaattggggaagaactagggcttggaatttcaaatgaagattggggatttggaggagcagatggactccgattttgatgaacttgatatgtacggactcgtggcgagacgaggattccaaaaatgtaagtttcgtaatttttcgagaagcgggcccggggctcgggttttgctagtttcgagattttggctatttctcggttgttttcgattgggtattgtcccattggcactttgtgatgtattcgctctgtttttgcttagattcgacgcgcgaagaggccggattgagaggcaaaggtgtcgcgggcttgagatttcgccggttcgaggtgagtaatgctagtaaatgttgttctgagggtttgaaaccccggactttcacatcgtaacgctatattgaggcgtgactcgcactcccggatatgtgcggagtcggatgttgttggggattgtgacttggtccatcccgagagagattctatggtatactagcgtatgatacgcacactgtgatgattattattgggctatatgccgtgtttggggcctagtgccgacctgtgacatccttcgggagttgacatttctgtttatcatgatcgcatatcctttcatatcagtccatggcttttaaaatattgttttcaaaacccagtcgtatttctaatgttcaaaaactcgcatgctatctttaaatgtatttcggctgaggatcatgacttataactgcccaagtggcttgtgatatattttctggactgattttgggtggctcggactgcacgccgcagcagtaatataatcggccaggtaacatggactggcctggtattgattattcgccacgagatggctgtccgccgtgggccctttgtaggtagatccggtgagactttgcattgtattcgtccgccgtgggccctttgtgggtagatctggtgagactgggattgtatttgtccgccgtgggccctatgtgggtagatccggtgagacttattgatttttgccaccacgagatggcttgatattgcgcttgggctgtaggagcccctccggagtctgtatacacccccagtgagcgatgtcgacgataaatgatatggttggctcggactgcacaccgcagtgggtactggattgtaccaacatttgcattgcatagctccctgcatttgcaccttatatatttattgttcagttgttctaatattgtggtattctattatttagcttactttgtgcatttactgtgttttcttatcttcggagcttcatttattattattactcactaggtcggagtactcacattactccctgcaccttgtgtgcagatccagggcatgctcaggcggattagatcctgcagcttttcagacatcagcagttcggagcgttgaggtagctgcacggcgttcgcagccatcgaccctccttccctctatctttatttcctgtttttcttgtgtactttcagttgcaaccagatttgtatcagattgagttttcatcctagaggctcagacttgtgacacctgttcctaggggatttgctattggtttcagtttctttccgctctgtctttttgtatataaatctcttcagtgttgatactattatttctttattgtaattatctgggattattgagattgtggtcgggcttgcctagccttacggccgggcgccatcgcgaccgggtttgggtcgtgacagttttcaaggcctcagaagctcgaaatgactaataaaataagtgatgacccctttgggtcgtcacagtaaatcaaactcataatctcataaaaataatgcactattgtttttttatatgagccataaatgttgactggataattttgtagatatgcccatcttgaaaggctccatgaaggttgaatgctggtagtgcactgcagtatgtttgtttcttaggttccttgaaaccactgtttagtagctgtaattcaaagtagtatctggtgagattgctatgctgtttcagtagtatttttgtattcctggaggcatgtgtggatgaataattggtgcaaatggtacagtttcatcagagtgagcacataagtgctaataccactgatggaaactacaccacttgcagagttaaacaccttgtacctgcaaaaatagcaaaattattagtgaaaataggggtggggggctgactcctgaatggtctgcatcctgctagctatgccttggcttcatagcttccaatatccatcagaagtgagctgaacttctgtgttgtgggaaacctgcagatatgagtattatcagatgcaactatacagcatgaccatatatgcttgcttctctgttcctcaagtagtggttttctgttgatctcaaactctgtaggttatttctgcattgtgtaacaatgtggttgatgttctcctgaagctcataaggttatcagcagaattcaattgaagtgattgccatcttcttggtacagaacacttgcagagttcttgatacagatcacctgtaaaaacctactaattcacttcaatttcgtttctttggttgaggttaactgaacctctagttctatcgactgggaattatttcagtttagctcatttattgacatttgagttttcagttttgttacctttatgactgtgttcttgatgttttctctgtcaaagttattattatagagtttatatcattttctttttgtccaggacgccataatgtctaaaattctatctgcgtctcagcctgaagatgggtccagtgagcctcctgaagttgatttctcacaaatttatttggaggaagtcggtgttaagaagacgcgcatttatggtcttggttctcaagctcctttctatgggcatgttggtgcttcctccagctcgatatctccacctcaagatctagacttcaatgctcgggtgagtgaatgtgtaggacatcgtttgcaagaaattaaggaagagatgaagcatgagatgagatctgagatcagagaagagattagacaagaaatgagagaagaaatgcgtgaagaaatgagacacgaaatgcagcaagaggtgcgcgagcaagttgatcaactactccaaaaccgtctatcggtcctcataggtggcttacctacaccgccttctcgtagacacgactcgtcgccaaatgacacgagtcgtatttagatttatgttagcttcttttatgttagacacgtcttggattctgcaactcgtcgccaaatgacacgagtcgcatttagagttatgttagcttcttttatgttagacacatcttggattctgctttcaacttcatgatagatattattatttataaagttttagtatgttttttattttgtttatgtttttttgggatcttttaaagctttaaattaatattaatacaattattataaccatatttgttaacgaatttgaaatttatttgtaaattgcctacaatttactaaatagaacttttccatagacaaaattaccaaccgattgccaatgtatttttaaaaacatactatcggatttaccaaccaaattggtatccattagtatagttgctaacagaatactaatggaatttttcttgttactatatttaccaaccagttacaaacacaatttaaataatcaaaaactaattttactaactcaatttctatatgttagtaaatttactaacgaacatccaactgaatttttgttagtaaatttaccaacgaaaatcttggactcaagattcaaaaattgccaacaaatttatttggtgtttattaactaatttttagttggtaattttaccaaccaattcaatatggttggtaaaatttaccatcgagccttttagcaacaggtcaatatccgttggtaatccgttagtaattcaaaatgccaaccaatttgatcattttaccaatatattttttttgttggtaattgggggttttttgtagtgataaacccaatgatttgttggatcggcagttggttatgaatttctacacatctcttctgtcgtggcagtattgggagagtttgaacaagacttatatcttttatgaggtgcatggtgaacattagattcagggaatgtcgattattataatcagagaatgttattatggtcccgtgaatgatatggtacatggtgagaattcagcaaaggcatgcagtcatgttttggtgccttgtgtaatgattgatacggcgttcatatattgcaagcaggcctggtagagaattccggatgttggaattgggctctgagcttatttgcttgaatgaaagaggatatcttcagattttctcgagctaatgtgctcgacggagttttggaagcacgggtaggtgctcgaggtgttaaacagtgatttcggatagctccagtgcagttcttagcacgttcgagggcaaacgttcgaggacccgaccggtcgttttgagctctagcgtgccgttcaacagtttgaggccatgagcagcttcacttcaggtattatgacttgtgcgcatggtcggaattgaattccggggaattcggagttgatttggaaagagaattctcatttcggaagctttaagttgaaagaattgactaaggttggatttttgagtaaataacctcggaattgggattcgaaggttccagcaggttcgtatgatgatctcggacttgggcgtatgtccagaccgggttttggaagacccgaaaaagtttcggcacctattgtggaaattagcatttggaagaattttataagtttgggttaaagtgcatttcagtgttatcaatgtccttttgggattccgagtctgggaataccttcgtatggtgattctcgtattgggagcacgatcgaaagtgaattcggagatccgtgggttattttggagtcatttggctaaagatagaaatttgaaggtttttggagaagtttgatcggaagtggactttttgatatcggggtcggaatccgattttggaagttggagtaggtccgtaacgtcaaatatgacttgtgtgcaaaatttgaggtcaatcggatgtgatttgataggtttcagcatcgaatgttgaagtttgaaattctaaagttcattaagcttggattggaggtcgattcatggttttagcattgtttgaggtgatttgaggcttcgagcaagtccgtgttatgtttttagacttgtgcaggttttgatttggagcctcggggcctcgagtgagattcagaatagcttcagagtgatttggtaagaaatgggactactcttactggtgtgaccgcatttgcggtgttttggtcgcaaatgcaatatcacatttgcgagacggagctcacatttgcgaacctggggctgctgaggaggggatcgcatttgcgagtgagccatcgcttttgcgatgctgtcctcttcgcatttgcgaggattctgccgcaaatgcgaccatgtcagggggaagctgggcttcgcattcgcggtgcttttgtcgcaaatgcgacatcacacttgcgagcctggagtcgcaaatgcgacttctgcgcctggtgctgtggctttttattccgagacttagcccatttccctcatttcccacttggtcttaggcgattttttagggcatttgaggaggggttccatcatcatcaaagaggtaagtaatttctacacatcataagttaaatacatggattatgggtagattaacatgtgaaaattaggaaaaatcaagggttgtagatgaaaaatctagaatttggtaaaaataagatttaaccacgaaattctttagggaatggagcaaaaatcatatattcttgatctataggttatgggtagcaattttcttcaaaaaatttcggaatccgggcacatgggcctagggatgaattttaggaatcttgcatttagggttgaaaaattggtttaataattagaatatgaacttttgagcatgtattgacgagttcttaccttatttgaatagttttggatcgttcggctctgaattggaggtttgagcgcgttcttgaatcggaatataggcttcggagcgaggtgagtctcctttctaaccttgtaagagggaattgtccccataggtgaaataattggttatgtgctcctatttgtggggggggggctacctacgcacgaggtgatgagagtctgtgcgtagctactattatgtttaagttcgagtagtctaggatccaaaagcatgttgtacttgaaatatttgtaatcttattgacagttgaattgcttaaatcctatcgaattggtaaatgaatttctaaaaggattaaacttcattttcttaaatcgataaaagagaattggtttttatttggataaacgttccccgataaattcttaattttctgtttgagcatgtatttctatgtgtacccgcatcgcgtgtatgattcgcgagcagggtgtttgtttatttatgttgaccgcgtcgcatgtatgattcgcgagccgggtaatagatgcatctatagttcacgacgttcgatcctcggctgtgcacattttatatttatattggatcgggtcgtacgacctcggcatgatatgcgcatgcttgtattgtttgcctgagatttataaatgttgatattgcctttcttggccggagataaattgataaaagatgatgaaaagtaaatctttggaatccattattatttgagaagttgtttacctattatccccctttatgagtttataattgcttcataaaaattcatgatctcctcccattttttttacaattattattattggaccactagtaagtgtcgaagtcgacctctcgtctctacttcttcgagataagacggaatagttattgggtacacgttattttcgtactcatactacacttgctctgcatttttgttgcacaagcacatgcatctctagtgacctagtgggcgtaacacatgattgatacggagacttaggtgagctgcatttttcgagacgacccgcagccagcagagtctctttaaaattatgtatttactttctgacaaatattatattccggactgttgttgtattatattatttcaaagaaattgctcatgcacttgtgacaccgggttctgggatgactatgggtattctgtatttactcctaaacattcttttatatatttttcctttgcaaagattatcttttactagctgaattgaaggaaaatttcagttttcaaaattactaagataagaatttaatgaagtattttggttggcttgcctgacagcggtgtccgacgccatcacgacccttagtggattttggatcgtgacaatataagtttccaagtttagatcgaattgataattttagaattaatataatataccaaacagttaataaaaataatatcgggataattatttccaagataacttgtcgtcaatccaaacgatccttaagtgggaaatcagaaagaaaaaataattgtccttcttgtttgacttgaaacacataaagagtcattgggtacgtcattgaagtctttgggttattgaacaggtcagaagagtatatatacaccactatttctagatattttaggataaggtagtcctacaagttgagcaaactttaaaattctttattgcatgattatctagtaatatgtcaatattcaatgtataatgatattatctccccacaagttctgtcgtccccccctgatgcctttggtgtttagatatcttttgattgaattataatatacctattataccaataagggtcacgcggaatgactgagtaagtattttttattcttaattaataattcgagattgaattctgattataaaataccttttattaaaaaaaattcgcgcgaatctgatttaagtcgagccctaataaatgctaaatgctgattaatttttaaaaaaaaaaaaaaaaagaggaagatgttataaacatattatattatggatgttcatttaatactccgttgtaaataagcttcccgaagaagcttatccatatgtgactccgctgtaaatatgtttatctatttagtactctattggaaataagcttcctgaagaagcttatcactttggtacccggttatggataaactttacccccggtagaagattatccataccggttataataagcttatcctttcaatatccggttatggataaattttacccccggtagaagattatccataccgggtatattaagcttatcctttcaatatccggttatggataaactttactcccggtagaagattatccataccaggtataataagcttattctttcagtacccgattgtggataaatattactccccggtagaagattatccataccgggtataatagcagcttacacagcagcttcctgaagaagcttatcacttcgatacctggttatggataaacattatctccggtagaagattatccataccgggtataagagcagcttacacagcagcttgcagtagcagcttgcagtagcagcttacacagcagcttgcagtagcagcttacacagcagcttcctttcttctataaatagaagagacttcagttcattatgtacatcagtttgaaagttcaaataatatatcagtttctctctatacttgtctttactttatagtcttaattttataacacgttatcagcacgagactcttccatctcgagcaaatagtttgaaagtatctgaggtaagaactttcttttcctaaataatgtcaaatctttctaaacgtgaatttgttaccctagatgtatcgggcaaaagctacatgtcttgggtgtttgatgctgaaattcatcttgatgcgatgggtctggcagacaccatcaaagataaaaatcaggcatcaaaccaagaccgtgccaaagcaatgatattcctacgccatcaccttgatgagggcctgaaaatggaatatcttactattaaagatccagtcatactgtggaataatttaaaagatagatatgaccacctgaagatggtcgttcttccacaggcacgatatgattggacccatataaggctacaagattttaaatctattattgagtataattttgctatgttcagaatcatttctcagttgaaattatgtggtgataatattactgatcatgatatgttggagaaaactttcaccactttccatgcctcgaatatgctcctgcagcagcaatatcgagagatgggatttaaaaggtattctgaacttatctcacatcttcttgtagccgagcaacataatgggctattaatgaaaaactatgaaagccggcctactggttcttgtccattccctgaagtgaatgagacgaacttccaccaagctaaacgtggaagaggtcatggccccagtcgtggtcatggccatggtcggggaagaaatttcaatcatggtaataataatgcaccaaagaaccctcctcgccaccagcagtggaaaaggaaggaacaaaagcatgaagcggtgcaagaaccaaatgtagaaagtccatgctatagatgtggaggaaaatggcactggtcacgtacctgtcgtacgccaaagcacctggttgagctttatcaagcctccctgaagaagacagagaaaaatgctgaagcaaattttatttctgaagataatttagacttcatgcatttggatgtagctgattaccttgcactcccagaaggagaaacaagtcatgtaatcggtggtgaatctgtagaaatgtaaatattttaatttttattgtttgtaatagatagtatggttatgtaattgttgtacataaataaaagttatgttttgataatgatgtttattataatatattttgaagaatatggataacatcattagaccaacttaaactctagcagagtttgccagaaatatacaaccactagaagtggttatatttcgtatatctcattataactatattttgttaaccaccagaagtggtatatgcctatgatcaccagaagtgataatttaggctttctatggttataattgaagataagctacataaatattctctatattaaatgcacacctcgatttgctcctgaagtagtaaatattttaaaagaggttgaggcatcacaatttgatgtgattaatgcgcattcagatatttatgttcgatttcctgaaggatgagaacttttgataatattaatccattccctgaagtgaatgtaacaatattaataaatctcataaatatgaacgcgctcttgatgtgaatatattacaattcacctccagaagaagtaatataattgagagaatatatactcaatatttcgtattttaaatttgctccagaagaagtaacacaattaaaattgcctcctgaagtaggaaaatattatgaagaggagttttcgtgtgcttaaacaattattttacattgtttatttgattgtgattttctctcatgataccagaagtatctgagcaatatttgatagtacaaaatgtatcaacaactcctgaaaagctaactgtttgcctaaaggatacatgacaccagtagtgtccgataaatattagattgtggataataaatgaaggctctcgaagagcttatatacaaatatgccattcatattatatgattatggtcaaaatatatgttgtagtaaacctgaagtttactactacaaatggctatcatattgagactacaaatgattggaagattgataatcttcatgcttccacaatcatagggggtaaaataatatgtatgtgagaagttacccgccttattctttaattctttaatttgtactatatcatgtatcacagtaaaccagaagtttactaaagcaaaagtttatcccatagtaaaccaaaagtttactaagagatagcacatgccatgataaacttgaagttttcatatgccatttttaaatgagctatttgagaattcagataagcatataccgaagaactagaagattcttcaggaattctcatgtgttgcttgttctcataataaattgattctaccagctaaagttgggattaagacccctgattctgaaatatataaaaggtgaatatgggcccattcacctatcatgtgaatcacttatagatgcatctataagatggttacatgtatgtttattgtcaacctgcagtttggcatttgagattgcttttctcaattaagagcattaactttcagattatgaaatcaagacagttcatcttgataatgttggtttatatccaagccggtttagcaatgaatacctcctactaatggctaaactattgcttatgagaacaaagcttcatgtgttggtctaagattttctaaaattgcatatagcagcacttgtatgcatcggaccaacaatatatgataagtcctcccctcacaattggtttaggatcagaaactaaatatttttactatcttttgatgtgtggtatatgattaatttctctaccacaatgcacagagatatgttccctaaagaagattggggatatatgttagtttttctaacatttgggggatggaataaacagctgaaaaatatgttatatgaatcgaattatcattaatatgattctcacttagaagataattcaagtaaaatgccagaagcatttgctgatccaaaattaaatatcatatttcagctgcaaatgctcctattaaaattaaagtccctggaggataaagtttactacacgcatgaagcgtagtaaatcgatcggttccaaaggtaacaatccttgaaaaacgataggagcaaatgatcaaaatgatcataataaggaggaaatgagctctagaagagcccacgacataacatttcatgaaactccagaagaagttcaggtacctgaaaataaagaaagtgatgagatctcaacaagttatgtcgcttaggaactgaaacaaaatgatcgtcgacgatatatttgatacaatatagtgcacaatactgtaaaagattgtgaggatcggaccagcagtccagacacttgaagatgtcataccatttagatacaagtcttaacttgtatgacttatttgattaaatctatatgaagatccttgaaggattgaaaatgcctgaagcatataattcaatgtcttgagaaatgtactcgatcaaattataaagatctttgtacggttcaaagcaatctgggcgcatgtggtataatcgcctcagagaatatttgctgaaagaaagttacataaattattttatttgtccatgtatttttatatatagaaaatgtcatcacaatttgttacacttgatgtttatgttggtgacataaatcttattggaactccagaagagctccaaaaggatcttaaaaagcttttacatggacaaagtatacccattaagtacaccaacggatattcaatcacttgaagtgaataaggatccattccaacctctagaagaggatgaggaactcattggtcctgaaatactctatctcggtgtaaatggtgcacttatttatcttgctaattctaacaaaagtggtgcagatcgtattgctaatgcggatgcaggttatttatccgatccccattaagctcgatctcaaaccggcaagcaggaagtgcatatgattgagatcagtgattcattcgagaaacatgtgggttggaatgtgataaaagatccacagtattaaacggagacaatgtttcatgcatagccctattaaagggaggatttataaaaggttatagaataagcacatttcaccaaaattattctacacacacgaccttcagaaaaatggtgacattgatgtgcaacaaatccgttcaagtgataatctagcagatttattcactaaatctttgccaacttcaacttttgagaagatggtatacaagattagaatgcggagactcaaatatttgaaacagggttttcatcagggggagtaaaatacgcgatgcattctttttcccttactaaggttttttcccatggggttttccttataaggtttttaatgagacacctagcaatgcgtattactaagtatgtgtactctttttccttcactaggattttttcccacgtggtttttcctagtaaggtttaatgaggcacattatcttttaatgaacatccaagggggagtgttataaacatattatattatggatgttcatttaatactccgttgtaaataagcttcccgaagaagcttatccatatgtgactccgctgtaaatatgtttatctatttagtactctattggaaataagcttcctgaagaagcttatcactttggtatccggttatggataaactttacccccggtagaagattatccataccgggtataataagcttatcctttcaatatccgattatggataaattttacccccggtagaagattattcatatcgggtataataagtttatcctttcaatatccggttatggataaattttactcccggtagaagattatccataccaggtataataagcttattctttcagtacccggttgtggataaatattactccccggtagaagattatccataccgggtataatagcagcttacacagcagcttgcgtagcagcttacacagcagcttcctgaagaagcttatcacttcggtacccggttatggataaatattatctccggtagaagattatccataccgggtataagagcagcttacacagcaacttgcagtagcagcttgcagtagcagcttacacagcagcttcctttcttctataaatagaagagacttcagttcattatgtacatccgtttgaaagttcaaataatatatcagtttctctctatacttgtctttactttatagttttaattttataacagaagatacctatcacgtttgattttaagttattttaatttaggcgccatatatctttgtttttagttttggtttgtcggtcgatgtacgtaagccacttggtcatattgacgtgttctaaggacaaggtttaataaatggttaaccattagtatcaataatggacccacaaaaatagtgaaaataacatgagctagtcagtttttggatcggtaatcgaaaaataagtaaagttactgaaacaattatgactattttatgcggagataaaatctggacaaaaatactctagctgaaacacggaaagatcctgattataaacttgagcatattatgttggaactccagtacattataaaattccaatacattaaaaaactcgacctacaacatattaagctggaatttttccggattttaatgatgtttttgttcatattttatctttaaatgaaaaagtgattagatttcgattacttttaatattgctatttttcagttaccaattataaatccggctatttttaatttttccggcagaaaatatggttgagattgttttgcagtttgagattttatacgtcttggggtatttctgactaagagggtgtttggctaagcttataagctggtcaaactggcttataagcactttttagcttatttacgcgtttggtaaaattaaaagtgcttataagttaagtgcttataagccaaaaataagccaaaagtcataagttggtctcccccaacttatcaaatttcagcttataagcactttagatttgaccaaaatatttactattctatccctaaaatacttcttttcaaaatgaaactcttcttatacccaattcttcagctgcttattatttatttcagcacttttatccaaacacgtaactgcttattttttaaatcagcttcagctcttaaaagtgctttcagcacttaatacgtatcagctactctaagtcagctaagccaaacgggctctaatacatatttttttttttttccacctgatgttcatattaaattggaactcgattaatttgcacttgcactgaaaagtttctctttagagataaagtattttttactaaaggcgattttatttttaactcgaaacttctaattaaaaataaatatattaaaattatattattgaattgatataaatatcgaatacagacaaatattgacttggcgtctgtttgataagtcaactgataagtgactgtttgacatattcttatgcattatttgtttcttcactcatgttttaatttgtaggccagcaatcccttgcacgtggtttgactcttccgattctccctcaaatacttgttcttaaattaaaaatatgcataaaatatcaaaaatacttttatggcataaaagttattttctacgtttcaatttagatgacgtaattttatttaatacaaaatttaaaaaagacctttgaaacatatgatcttaaaaacttaaggggcaaaaattttgtggacataatatttgtatagctataaaactttctcattagaataaagtgagtaaaataaaaagtttaaaggtaaattatttttaactataaaaatatattattttttttcgaacggattaatataaaagtgtgtcgtttaaattgaaacgaagagtatgtcatatgtattagtcctaccaggagcgcaacttaaggtagaacattataataaactaatcttgacctggattatttgactcttaataagcaatccattcgtagatcaggttcttaatttcttttggagttagactgtgaaaatatttctttgtttgacatttaatttggacttgggttttactaaaaaataaggggatttgaatttatgctttgagaataagtgtgagttctaactcttcaacggaggtggggcgaggacttaaaatttgcgggtttgagattctactccttttaagttatgggaatctacaataataatttttatatttttagtgaatttcttataaaataaatataaaatttgaactaaaactactgcgttcaaccgcaccaataaactaaactctagcttctcctctagttcaagactctcttcacgtggaaatgataccgggtagccacttttaagcatactgtttaaaatttatccacaatttacaattaaagattagccaatttcgttcaagcttcaagacacgatgtcctagagtttaaacctcgaagttcaaacttcaggatatcgtatcctaaagttaaaaaattgtgtcaaaaagttcgaatcttatgtcctgaattttaaattagtagttcaaaaattcatgacacttaatcatgaatttcaaattaccagctcaaaaattcaggacacttatagcctgtttggccaagcttatttttggccaaaagcacttttgaggtgtttggccaagcttctggaaggaaaaaaagtgcttttgaggagaagcagaagcaattttggagaagcagaaaaaagtagcttctctccaaaagcacttttttgagaagcactttccagaaaaatacacttagaagtagttttttaaagcttggccaaacactaattgttgctcagaagtgcttttcaaactaattagccaaacacaaactgcttctccctaaaagtacttttgagaaaagcacttttgaaaaaaagcgattttcaaaataagctgatttttgcagcttggtcaaacgggctaatagtcctgaattttgggtgacttagctaatctttttatacattgtaaattatggatatattttaaataacggacttaaaagtaactattgctgaacttcgccgaggcttcacgttcactctctttactgccacttgtagttgtagagcaggtttcttcgtatcctttggtccacacaataatgtaaaatttccctcacacgtcctagtatacccttcccttcaattagttatgctttcaaatcttactataaatagaacccaagattacatcagtttcttcatcccttactttcaaactaagctttgaacaaaaaaagaaaacatgggttctaaggcatttctgtttcttggtctttgtttggctatttttttcctgataagctctgaggttgtagctgctgagttggctgagacttccaattgtaagcttactctcattttactctgaaaaaaatgaaaatctcttctctcattatttgatataggattcaactaataattattttgtacgcattgatgtattttaacatgttgtaacattctttaacctttcaaattagtgtttgtcagctagtaaagctcaatttgatttccacatcgagctagtagttgagttacacttttttatttactatcgctatagcttgatagtaactcttaatatgtagttcttttatttcaatttaagtgttttaatttggctagatatgaagtttaattgagaatgtaagtaaaatgtttgaatcttgtgattttatactaaagttgtataaaaacattccaaaaatatcctttaaatcttgtggtcttaaacatgtcttctataagaagagccctaaaagggcaaaaatgagaatggtggaacttaaaacttacttattgattaaatatagaaatagtatttattttaaaacataaaggaaagaacgacatataaattcaaacatatgaagtactatgttttaattttcataattgatgcagcaatgaaattggatagcgagaatggagtatctattgacggacgtagcggatacaatgacgttggcggtgatggatattatggtggtggtcgcggccgtggtggtggttataaacgtagaggatgccgctatggttgctgcaggaaaggttatcatggttgcaaaaggtgttgttcctacgcaggtgaggccatggataaagtcactgaagcccagcctcacaactgatcattatgtgtattatataaagagtttaagttatatatgccgttagtgtatataacttatacgttgtgacaagatgtaataatcttgctactttagaccttgcttgtaacaagtatgaataaagccattcggttcatagggatggttggtcatgtaatgttttgttgtacaatatattgtgataatatgtttccatatagtttattttcttcaaatttagagtaaaggtttttcttctattttatgaattctacaattctcttttaaatctgcccgcgaatttacaattcaagtagatctatggaaaataaacctatggcaacgcacagaaaaccgttgcgatatataataacaccgttgccattgagctattgcaacgtttttgcgtccgtctaactaggtcgcgctgcagtagccctactacaacggtttgcaaaaccgttgccctatatgtctattgcaacggtcatttatcattctactgcgacaagtattttgaatcaactagaacggttcagaggcgttgcaatatatgttttgtgtaacggttatgtctgctattgcaacggttaagttaggttattacgaccattttttgccgcttttgcaatggtttaattactattgttacgggttgtttacagtaacaacaatctaataggttctaatgcaacggtgtgtattatctattgcaacggtttataatacctatggcaatggtttagtttacctactgcaactgttacctgttatattgcaaccgtttacatggttaattgagacagtttttgttacatatagcaacggttgaggtaagctattgtaacgattttattgaaccaacaatatactccctaatagtaaagaaatatttacattaaattataatacacaataatttatataaatcacaaaataaaaataatcataaatatttacaatccaagttgtaatatccgtaaaagcaaaatattagaacccatgtacataagtttaaaaatccaaaagttaagaaccaagtacataagttttgcaatccaaaagttaaagaagtttcaaaatatttgatatcaaaagattcctagaacatttagagtttcagcaataatccaaaaatcttcttaaggaggatcttcattccgttgatcttccctttctttattttctccacctacaaaagaggataaataaaattattatctctttaaatgctagttaacaattcaaatacaaataaaaggtcaagacttttaaaggatttaagaataccagacacagggcaatgccattcaaaagttgatgaagaatggagcattatcagattttttgttcaaggaaggaatgctgcctacttggagtcacagatcataaatggcactaggaattgcaagaggactgctatatttacatgaagaatgtgatactccaatcatccactgtgacataaagcctcaaaatgtactgctcgacaacaactacaatgccaagatttcaaattttgggctatcaaaactcttgaagaaggatcaaacaagaacaaatacttgcgcaagagggacagtgggatacttggcaccagaatggctaaagcatgcaccaataacacccaaagtggacatttttagctttggtgtaatgttactggagattacatgtggtagaagtcatattgagctgagcaggatagaggaggacgaagacgatgaaggagatgatttactacttataaattgggctgcaggctgcatgagaagtggtagaattgacaaactagaaaggggtgatcctgaagttttaaatgatattataagttttaaatgatattaaacgtctttcaattttaaaaccaaatgttccactcctatggcatcctcctctgtcgaaatgttgaatttacatgaaaatacattaactttctattgttacccattctagtttagttgactaggaagtatacttagaaggagtagaaccaatcaaatggagataagttgttttctcgctctgttatgcatagtagactagcaaagttagactatgatctaaatgaccaattctagcaaatgaattcatctacatattggaaaatctttccacataatcaaacaaaacaactgatctatagctgaagtagacgtggcagaaacaaatatgaggataaataaaataaagtgacatcacttgacacaaacaagacatctatattaaacttggctttaaaaatatcatcaaagaaagccatgttaaagataggaaagcatggaatcaaaaaagatgcatgagtagtctgcctctatgtgttgtgaatgacaaaagagaataagaaaagatgcattggtacctcattttctttgttgctgcttatgagtggccccaagaactgtctgcaatgcattggatgtgggtggcctgttgtcttcttctaaagtctgtacatgacatgttggactggtggcatttccaagcagatgttggtctaattacatatttagagagaaaatcaattactagatatggtttctactacttgaatttgtcaactagttcgcataagcacattgatatccttcatgtttcaagtagtacatgaccagaaaggaattaagaaataattttagcactcaaatgaataaagaaaagaacatattgcatgatgtccaataaagctaaagtgcataaaattacaacttgaaacaaaacaatgtccgaaatcaacaagaagcaccccagataactaatcaaatatcataaagttaagacctcattgccaaatagatactgaaacacgaacacattagactccccttactggatgctggaaagtagaggaaatttcagtggtagctctgcttggcgttatttgagaagaagagaggatcctaggaggctattcaactcagtaccatgttcaagtcctatgggaggagaacatggtaacaactctttttaataacagtttttttctttttttgcaggtgataatgatatgtatttgccctgtactttgatgaatctccatgtggtggtattagtgctgtgcactcagtccacaggaaggaagttaaggccgggcaaagacatggaggcaaggacaaactcactgatgaatgcaaccagaaatgcagaggcaaagcaaggcactctgctacccagtcatataagcagcagcaacaggaataggctagagacagcagtaaaatttgacatggtacccagaaatcatgctactgtaacaggaaagtcaggaatcatgctactgtagcagcatgctaaatggagcagcatgggaaatcgtccaattacaatatgcaggtatagtgaagaagaagaagaagagatgcaatattttgcaataattaagtacacaccttgattagtactgccagtagatggacgattgattagttgaattacagcttgttgtgcagaggaagcttctccgagtgaacgaccaccgaatgctagcatattaggatcaattcgtaaatctgggttaatatgctgaagttgtgcaacaacattaagtgtatctgttgccgccaagtttcctgttgttcctcgaagtttttctacatcctttgttgcattctctcttccattttctttattttttgctccattatctcatcagtagtctttgaagagggtctagaatttctagatttttgtttcaagatagtctttgtaaccccacgaccatacaaccttacgcgacctggatgttcaggcccatgacggttgcaaatgggtcaattgattggttatcatcttcactttcttgagtttgtatttgctccatttcagcctacaaataaaatttaagagaagaaaatacaagtaaataaaatgtcacgacccaaatcccggtcgcgatggcgcccggccgcaaggctaggcaagcccgaccacaacaatccaataacggcaattacagcgcaacaagaaacaagttccagatttaaaacacatttaatatatcaaaccgcccagtcagggccaagacaacatgaaagagatagaagaattcaacaacttttcccaacatcaagggtcacgagtactgagcctctaccaaaacagtatacaaatctggaatgtgagaaatacaatgtctgaaagattgaaagaaagataaggaatcggagaagtgggtcctacggacgcaggcagctacctcaagtctccgtctatccgacaatcagcaacactaagcctcaggagcacctgaatctgcacacaaggtgcagggagtatggggtgagtctccaactcagtgagtaataagcatatataaaaacccgaaagcaggaaaaatacagtaaagcacaaggtaaagctatctacacagtttcagtcagaacagttccaaatatatccagataagcaacagagaatatgagtatgaatgctatgcaatgcaatgcgcatgtccgctacggtacgtgtagcccgatccatctgggtacccgcgctcactgggggtgtgtacagactccggaggggctcctacagcccaagcgtcatatcataatatcgctacggtacgtgcagcccgatccatatcataacaacaccgctacggtacgtgtagcccgatccatttgataaatataccgctacggtacgtgtagcccgatccatatgagtgcaagatatgcatgagagtcactaaaccatttttcttatagattttagatcccatttataatgcatgttcaggtcacataacttcaggaaatcatgatctatgcaagttaaacacaatgaagatacacagaactgagttcaaaaatcgatccctgaaggatacctcaagtcggcacaaggccccaaacgtggcatcaagcccagatatcatcaatatagaaaagcgaagcaatcgctaacacagtaccatttatccctcggattgggaccgagtcatatttctcaacacatacgaccccgcactaccctggagtgcgtgtctagctcacaatagcgtcatcatgtggtaaaccggggtttcggaccctcggataattatctacacccattactcacctcaaaccggccggaaaactagcccgaaatgcctttctccttcaaattcacctctccgagcgacgaatctggccaaaaccacaacgaatacattacataatgctaatggcacataacccaatcgaaagaactcgaaaaataactcaattcgcgaaaatagcaaaactcgagtcccgggcccacatctcgaaaaccagaaaactttataccaaaacgaccctcgactcgccacgagcccatacatataaatttcatcaaaatcggagtccatatgacccctcaattcttcaattaaagtctagttgggtttcaagccctaacctccatttttagcttcaaagaccttgatttctaggtgtttaattcatgacttagcaccataattacatattagaagtctattgaatcttacctgatgaattcctttggaatcctctccaaaatcgcccttaaatcgcctcagtccgagctctcttttcctctttctatttgaatgtttaaaccctctgatttcattaaagactgctcgacttctgcttaagcggtccatttccgcttaagcggtcaccgcttaggcgatatttcttccgcttctgcggtttccttcaatatcctagcggccgcttctgcggtcgcttgaccggttatgcggtcccgcctacgcgatcccaaaatccgctcatgcggtacctgaccgcttctgcggtccttcatccgcttaggcggacccgcttaggcgaccccacttccgcttaagcgaaaataccagaagcagcaggcttcttttaagcttaactccaaaaatctcccgattgaccatccaatctcaccccgaggcccccgggacctcaactaaaaacataaactcactctaatacttcattcaaacttgctcgggcaacaataacacgagcttaaacatcaataatcatcaaaattaccaaatcaaagcctaagacaaccatgaacttcccaaattcccattcgatgacgaaaccatccaaacgaagcccgaatgttctgaaaatttgcaaacatactcaaaatcacctaacggaaccaatgccactctcggaattccattccgaccgtcggatcaatttctcacctaacaaccggattcttccgaaatctaatttcgccaaacttagctaacttccacaccggatctccgaatttacttccgttttaactcctaagtcataaatcaactcccaaaactagtcgaacatcggaaacccgttccgagccctctaactcacaagtcaacttccgattgactttttcaacttaaacttcccttaaagagactatttgtctcaattctaaccaaactcaatccgaaacacttcaatctccccaaacacatataataacacatgaagaagcataaaacggggaaaacgggacggagatacaagagatgacggatcaggtcgtcacatcctccccaacttaaacaaacgctcgtcctcgaacgtactcagagctgtactagaagcaacccaataaccaaatgacattaccagacatatgcccgaggtgatcccacgtcaccctaactcacatagataccgaaaatacagcacaactgaaatttcacgatccatctggcccataaatcgcagaatcacgttgcatattccgaaatcatacacaagatcagaatctcacatctatactcaaaattagcccgaaccagttgtaacaacccatacctacaacctcaggtgaattcgaacaatataccacgcattccaacactcggaacgatagtctttattcatagcagttgaccacaatactcaataccaatagacaacctcgtatttagctaaagccttattccaccactttcgcatattgccaatgataaccaaaacacgcaatgaactgtaacagttctccagatcaaccattcatgaagtcacttccatgtggactatcaccaccacagattttcgggtcaaacctcgatattatccttctaaccagctaaatcaaatctgcttatactcattaataacccaatgatcacctcgaatttaacacaccacagctggtgatatgatgcctcaatacaggcctaagccacaatttgcataatacactcgccaacccgaaacggtctacacatacccaaatctgggcaaatgactcaaccgaaaaagagttatacatccagctcatcaatacctttacaaaacaaagttgagacctcgtctcacatcataggaaatagagtacctgaatcctcctcgagaggtcataacttcacgtggcctcgccacaacacgcgatcatatcccaacactgatacacatgaaacacctcgtgctaccatgctcaaagcagacaaccatgcacatatcgatgcctaaaatcaagtaacccatcacactcacggtgaaacaagtaattgtaaggccctgaaatattttttcaagaaaattgagattttgtcgtgccacgtaggctaattattatgtgttatgtgctattatcatgatggacatcaattagacttggtaaatatgattataagtgttaggttaagttatatgtggtccaaatggaagcctaagtgtataccaaaggggaaaggtttcgtaatcggccaaattctgaatggattcatacaaggctccacttcaaacgagtatatctaattatgtataaggttttatgtggtaaatagcatatcaaatgaaaggtctttgattctaatttccaacgcttcaaaccgttcgtcattcggacattcctacacaaagttatgatcaaattaccaaatgcagcgaagatttttgtactgtcgcggcgcggccccgcggcgcgacagtgtaatttatcagagacttgcaattttgttccaaaaatcattttccactatcgtgtagcggccccacggcgcgcccccgcggcgcgatagtgcaaattttcggttttcagagtttaacccgacccaatatcgatatattacaccctaaccttcattttaggctcatttctggacatttctagagtgagagagagagggttttagagagggaatgttttccccatcaattttctccataaaattttgctaaatccttgaagataatcaagtgaaggccctatatcttcatcccaagaggtaagatttcaccaccctagctcttatttctattcttagctataaggagtaattaggaaggtgattcatgagtataagaagggatttcttacatgcatatcaaccttaagttattgaaatatagtgaactaatgagaaggtaatttgggtataaaaatgatagaaatatctcccaagagggacctaagatcatgatgcacctttagtgtttgacaatatgcttgaaccaagctagaatctcaatctcatctctaattcttgatctaatttgtaattcttactccatagatagaagtgctaaaggttccagaaattcgtaagagtaaggaatgctatatcaaggtatgtatggctaactttgaatcttgtgaaatcgccatatgttggctcgtgaaattgtttgttactcaatgtctaggtggaaattgttgtgtgagattgttgtggttaatattcatgtggtaacatcttgtggtggaagttgaggaaaatgaaattgaaatggttcatgaaatggtggaaatggaaatattgtggtaatatgaattgtgaataaactgttgaacatgaggaaaactattatcgattggttgtgggatatcttaccccttgttgtgattactttgtagtaagtggtactgttgattctttgaaactgttgttgtgatatttgttgttgtaaattgaagctgtgactgtagctctgtggtgtaaagatgagaaatatgagaaatgtaattactgttggtttgaaatgctcgttttacttatttgactacttgtgttaaagtggcattactcattccctaaatgcttttgttgttgtttgctgtaatgtattgtgaattaaactatcaggcggggtcgggttgcgcgccgcaacatggtgtaataaggtgtgggttggggcgataagggtggccgaggtaataagggtggacgaggtaataagggtgaaaaatgtgattcgatatcaccaatgaaatgattgaaactgaaatgaaaaagaaaagtgattaatgtgaattgtgaaaggagacaacaggagcgtgtgaaacctgtggggcattgattgcccctttgtatgactacgtgaatcagttgatgtgaaatatttggttaatgctttcattgtcattcagttggttatctgtttatgcatctctttcggcttgagtttacttgaggcagggtttgttatacataccagtacaattcaaatgtgctgacgtcccttttgccgggggcgctacattcgtgttatgattgtaggtggatccgtggcaggcactctggtccatcgaccttagctcctcagcacttcctatcagctgaattggtgagcccctttgttttcggggtccttcatggctcatgtcattttgtttcgggactttattttgatatttgtatgaggtatagccggagccttgttaccggcaagtactatatcatcctttttcatctttagaggctccgtagacaggaaagtgggttataaacttatgtaaagatgtattttgtatctttgggcgatgtaagttttaaatcacgctaaggactatgtttgttttgtaaaaaaggtttcaatataattggttatttcacttggcttataagtaatgaatatgcggggtaatacgtgggataggaaaggcacccaggtccgcttgactggggatacctggtcgagcgccggtcgcgtccctcgaatttggggcgtgacaaacttggtatcagagcctaaggtttaaagtgtcctaggatgtctcggagccgtgtctagtagagtccttcttatcggtgtgttgtcgaccacatctataagttggaggctattcagacatttaggaatttcacccttctttgatactccaattgtgcgatagagcccaagttagggagctgatttcctctctaagtcttattctcaagattggtaaccttgataccataatccgcgaatgtgatgaatgtaagaagggattgatcccaccatcgagtccgagtggattgcccaaagacttgttaggagaatgtattgaattgtggatggattggtaaatcatatcgctaaaggggggagtgtccttgtccctgttgatgtttccgcaccatcagatcatgtagtatatgagtatgttacctacgcacgtgaggaatgtggagtcaaggggtatcgattaagctattgccctatcaacttaacgtcattaagggagtcaaatgaaaatttctactcattgtatatgtacgtccatattgaagagtcctcatgaacatggtcttatcaaggtgttgaataacaaaacattgcgtgtatcgactctttgaacgagacgcactattcgtgaatccactctattctgaattctcttatttacattcttgtggaattaagttctataattatgccattgaattgagttataactctaggattgatattttccacttgctcttcctacattctcaccaagggactatatccgatgaatttcttaccgaatcttgttatttaaatggataaaatctactcgctttgtgcctatacatgcaccgtctaaagtttacctatgtggtgtcaagttccatgccaagcgacccaacattgcgatccttctcgagtcactattttacttagttgtatatatggattatatggtttgaacagtcaatctactctcttgcgaatatcatcatgaaattttttcactgcctcataccataagagcataccttaacatctcacatgagtgcatgtcaatcgaaatggtcaccgtatgcataaagtctctctgaaagattgagatccttacatccacgtcataggaagatcatgtgcctccataacgttcgtgtccacttgggacatcccatagtaagtagctcaccttgtcctagttttgtggtttcttgtggcatggtcgtatatagcagttgggagctaatatagcagaaacgtgtccaacttataacaaatgtttatctcctctttacacctccataacaagtgttaattgggttctttagttagtgaattcttgcgctagttttcccacacttgttcgataaccatgagaggacatatccttctatgagtcattgtaacactttctgtctcgtaaggacccttactaggctctccgtcaagaccaagcacacctttggaggttattataacacaatgcatgtctctcataatcttgtgtatttcattagcatctgagtagttctcaagttaaaatcaatgaagaactcattatgaacatctgcaaaccctccaggattattctatactatctcattgggttctcttatcacttcaagttcatcaagggttgatagcatgccgcaatttttgaaattgaatgatctctttccgctaatggattatctacattcgtgctaatccaacgatctgcttaattatcagtctaactctcgcctctgggtttgggttgacaaaggagaaatacacctagtaacacattcatatgtcaaagcctttctctccgttaagtcttgtagcatctcccaatataatttggaatagatggttgtgtagaagtgtgttgtagtgcttcattatgaagcagagttgctaaacataattggattttagaatcctagagctattcatcacgtgaattcatactgagatcttctttaaaaaaaaaatgtaccttcttgtcatcgctttatattaccacccttcctagtggatacaatataaaggttacttccttaaggctctttcactttcttttcatttgcctagcatggtgtgttgtttaccctaatcttcaatgtgatattatctcaatgtcttggctagtcatccaactatatgattcgattaaattcaccttatctttacactctacaagtatcctttttctaaaaggacaatgaaagtaggaaaatcccccttttattatggacttctaatatctttgacttagtttaagcttgttggttccaaatggtgctcattagttttgctacactactatctatttaatctgataactctcattgtaaaattcatttatgtttcatggcatcaacgaggaagtcttgtagcatttaaaaaggggacatattcctttagttggaataaataaatattgatggcattctttgtagatgttcttctaaaaactatttacccgctctgcttatccatgtgactagataacccaggttatttatcctcgataaatgcactaagacatctcattcattcgaacttatccatgtgggcactttgaggccttgtttcatactaactcgtaatggttttaagtactttcttgccgttgttgatgatttttttaggactacaagggcttgtttcttggattttcaaaaaaaaaaaagtaatgattttccttaaagttcgagatttcaattgccatgatttcaaaccaaagtgtatatttttttccaaagtcttaaatgggtcggattggatgggttacgtggctttcttctcactcagcttctagaataattgactatatcattgtcatgtgaggggagttttgctacccttggtattccacctcctttggtggataagagtgtcatttgtctttctccccagagcatcatgttaaccaaaatgcctctaatcaataaatgatttcgtcccaacatttagttgttctagctatgtggttttactcgtgaaagggtgaggttagatgtcttcagatttttgcacatatcacgagcatattgatttgaaagactaagttgtcgtatctttagttctctcatataggatcaactatcatggcgagttaagttgtttgaaaatatgatgatctcataagtgtacaacgccttttcatcctcatgagcttggggccaagattccgtgtgtcaggtaattgctaagagtgtaattcaacttcatgtattttgaaacctcgatcgcattcaaagtgccagagtagtcttattcttgataaatggattttccctacactctaggaaatgggtagttcacgtacctgagcattcctccttaatgattcctatcgccaatgtacgagttacccctatgccttatttgcctaataattgatgtcctcacagtgattaaccatgtcagcgttgttggttgtaactttcgtgttccttagcatataacctcataaagtactctactcagtgcattaatggattcttgaataactccagcctaatcttgaactctgttgttcctcattgtattagatccattgggtattgtaagttcagacgagtcaaagatgaagcttcaaagtgtgatcatatatatatttgataggaaattttatggtcagtttatgatagcacatcgtagagtaattattgaaggtcatcaagggtttagtgtgagtgttcacctagagatttagagtttggagggtgagcaggctattctcaatattttcccctacagatgttatgtgagttgataataaaggttgcataagtgtattccacattaggccgcaccaggagtatgaagtgtccccatagttgttcgccatatattttgtggattcacaagtctatgtccaagaaagtaggtggagaccaattgtgtatccttccggtggaaattattaaatgtgaagttagtggatagttagcttatgtgagatatctacttgttatcctcgttaagtaagttttggggttgaaattgttcatgtaaatgtattctggcgaagtttgtagatataagaggccgttaaaggccgagagtgttgtggaaataaaatattttctcttgattacatagcaattggttttgatttgaaaggtaccttctaggtgttatgatttaaaaatgtgcagtctatgcccaggtatcaccgtgataaagtagtgtttgtaatgttgaggttcttgtcattgatatatatataaatgttgtggtgcattatcgagttgaggaagccacgtgggaagcggaagaggagatgaaagagaaatatccccatctgtttgaacaggtctagtagtgattgtacgagcccttatctctagaaaaactaatgctatgctcaattcggtgcaaatacaccccattttgttttactatggtaattcctcaagttgtgcaagaattgtatatgttgtaattatttgagtcatgtgcaaacccctttttggtaaatgaaggttttgtaagaactcatgtgataggagaatgagtaatgtgaaatgtgtatggtataatggtaattggaaatgtgtttcggaggctctctgacaggtggataggccaagtcacaaaggaaactctggcgaaattttcgaaaatttaaggagttagcctaatttgaggttgttgatacatttcataatgtgaaaaaggggctgaagttacataagcttggttaatgaatgaacctcaatcctcattcgaggacgaatgatcctaatgggggggggggggagaatgtaaggccccaaaattttttttcaagaaaattgagatttcgtcgtgccacgtaggctaattattatgtgttatgtgctattatcatgatggacatcaattagacttggtaaatatgagtataagtgttagggtaagttatatgtggtccaaatggaagcctaagtgtataccaaaggggaaaagtttcgtaatcggccaaattccgaatggattcgtacaaggctccacttcaaacaagtatatctaattatgtataaggttttatgtggtaaatagcatatcaaataaaaggtctttgagtctagtttccaactcttcaaaccgttcgtcattcggacattcctacacaaagttatgatcaaattaccaaatgcagcaaagatttttgtactgtcgtgtagcgcccccgcggcgcggccccgcggcgcgacagtgtaatttatcagagacttgcaattttgttccaaaaatcattttccactatcgtgtagcggccccgcggcgcgcccccgcggcgcgatagtgcaaattttcgattttcagagtttaacccgacccaatatcgatatattacaccctaaccttcattttaggctcatttctggacatttctagagtgagagagagagggttttagagagggaatgttttccccatcaattttcgtcataaaatcttgctaaatccttgaagataatcaagtgaaggccctatatcttcatcccaagaggtaagatttcaccaccctagctcttatttctattcttagctataaggagtaattaggaaggtgattcatgagtataagaagggatttcttacatgcatatcaaccttaagttattgaaatatagtgaactaatgagaaagtaatttgggtataaaaatgatagaaatatctcccaagagggaactaagatcatgatgcacctttagtgtttgacaatatgcttgaaccaagctagaatctcaatctcatctctaattcttgatctaatttgtaattcttactccatagatagaagtgctaaaggttccggaaattcgtaagagtaaggaatgctatatcaaggtatgtatggctaactttgaatcttgtgaaatcgccatatggtggctcgtgaaattgtttgttactcaatgtctaggtggaaattgttgtgtgaaattcttgtggttaatattcatgtggtaacatcttgtggtggaagttgaggaaaatgaaattgaaatggttcatgaaatggtggaaatggaaatattgtggtaatatgaattgtgaataaactgttgaacatgaggaaaactattatcgattggttgtgggatatcttaccccttgttgtgattactttgtagtaagtggtactgttgattctttgaaactgttgttgtgatatttgttgttgtaaattgaagctgtgactgtagctctgtggtgtaaagatgagaaatatgagaaatgtaattactgttggtttgaaatgctcgttttacttatttgactacttgtgttaaagtggcattactcattccctaaatgcttttgttgttgtttgatgtcatgtgttgtgaattaaactgtcaggcggggtcgggttgcgcgccgcaacacggtgtaataaggtgtgggttggggcgataagggtggccgaggtaataagggtggacgaggtaataagggtgaaaaatgtgattcgatatcaccaatgaaatgattgaaactgaaatgaaaaagaaaagtgattaatgtgaattgtgaaaggagacagcaggagcgtgtgaaacctgtggggcactgattgcccctttgtatgactacatgaatcaattgatgtgaaatatttggttaatgctttcattgtcattcagttggttatctgtttatgtatctctttcggcttgagtttacttgaggcagggtttgttatacataccagtacaattcaaatgtgctgacgtcccttttgccgggggctctacattcgtgttatgattgtaggtggatccgtggcaggcactctggtccatcgaccttagctcctcaacacttcctatcagctgaattggtgagcccctttgttttcggggtccttcatggctcatgtcattttgtttcgggactttattttgatatttgtatgaggtatagccggagccttgttaccggcaagtactatatcatcctttttcatctttagcggctccgtagacaggaaagtgggttataaacttatgtaaagatgtattttgtatctttgggcgatgtaagttttaaatcacgctaaggactatgtttgttttgtaaaaaaggtttcaatataattggttatttcacttggcttataagtaatgaatatgtggggtaatacgtgggataggaaaggcacccaggtccgcttgactggggatacctggtcgagcgccgatcgcgtccctcgaatttggggcgtgacagcaatatacatcattcagtcctgaagggacacaaccgatacgctattcgccagcatttttcaatacagacttccctcggaaaccaggaagcaaggaatacaaatcatctcctggaaagctattctcaacatcacactgttgcggcgcgcaacctgatccagataacatacccgtggtggcgtgccacccgatccgtacaaccacctcacatagggaggtgtacatcgagccgaatttgctcataacaacaaaatatcactactggtcgtaagcaaactgagtgcataaagatattcatttagccttacaagctacaaaattccacttccactactaagactcatgacggagccgcaagagatggtgcttggcaccaaatgattaccgaaatccactgtctcgcccggcgacatgcccggccactagaacgcatctgaaaagtcccacaatactggattcgaaatcaatggtagaaacctctatattgacatccgcctcgaaggcccaattaagtaacgtaattcttcccagctgaccgctagtctctggaacacaaccatcccgctagaacatagtctgatacacatcgccacgcaacctgtggcgtttcccaacatgactcatagcacaatcgtttagaataatccgacactgagacaatcactctacgtccccatatcatatccaaaatttaatatttaagcaaggaaagatccgtccggattccaatctcccaatagccgctgacagtatcgatacaacacccacgatcctcaatcactacattgactgcaccggagaactcccattctccgactactcgtagcacacgaatcaatgtacctgatccaaatttccacaatgcggaatacagattatacctcaagtacccaactatcccacgagagatattttaaaactcccatgccatcaaacaactcagatatccgcagtcgatctcatacgaatctgccgtaacactatcgatgtatcatttgtggaattccctctttccgaaacatatgctaacgccgaatcactttcaattaacagtaccatttccttgattacctgaagctactcattgcctaagacatagccaaatccaccatacccttcagagctgaatcgaaaactcgcacatgcccatctcggccctttacaatataccgcatacgcaatatcttccaaggataacacgagaactttcatctctcttctgcgccgcagacatcgacgcactcaactagtctagaaccttcattgatctcatttagaggaaaattattatacatctcatgccatctcacatctgtagaaaatgcatctcttcaaccatgtataaatcaacaaggactatcccaatcccgtctgcacaactaaaccgccgtgactgaatcctttttaaatacaacacaccaagagaatcgtcaacacccaagagcattgctgcaaaaattacatgtgctaacccattacctcgactacacaacgagaactaagcatacccttaacatgccgaacccggtccatgatcaactacccatctatcaaatttccactgatccgtctttaattcattatttcctttagccgtagcaccccaatctttcaacccatacttaccacacgagatccacacataaaaccacactgtctgaaatccataagtcgctagatactctttcacattttcccagtaacacccgcatttcagaatgcctttccctaaagaacttcctgcgaacctaacgttgcttcctttaccttcctgatactgatacatagagtcccatagttatcttaaaaataccacaagtctcgacatctccaatgaaacactgtctctgaccacacacgaaaccttcaaacacctgagtgacacttatagaatcctgaacacatcaaaaccattttcaaaagtcatccactcttatacacaccgcaagttacttgacttaacgaatcaaaccattcgtgccttattagcactctgacaccaccgaacgtgatctcattccgatacaatccgacagattccttctctttacgctagacgttcttttatcaataactccagacattcccttattatctcacacccacgaagtaccatacaatctttggcaaaattttcgcttcacttgtgccaccctcggctcactttctgcagctagaactgattcacacacatgcatcaaatcagaactaatcatagtacataaccgtacaaccagctattcaacagcaacctccccaacttagatcgaagccatatatattaaaacacacatactctatagccatcataacatcatggcgggattaaactcactctcccataagcttgtggaaacacgaatcaccagaaattctaactttccttcaactttttgcattcattcacacaaccgttaagcccactcttaaggcgacaaaatttttctaagtctcaaattttccaaaaatttcggcagagtttcctttgtaattgagcctatccacctgccagagaatcaccaaaccatcctaacaacacgtccacaacttgacacatgaacatgcgttgtacctgttcgaatcataacatataggaaaataccttttaattacacataagaccttcaatcatccacataatggttataccatttcagaataatcttcaggagatacccacctgcttgcttcaatataacatttcggtacatcattcaccgtcacacacctcacgcaatcaattagccttcctgagtgtgggctcatacctccatacgcacactcctagccaggagactcgaaaagattcttcacgcacccataactcggggcaacacattcgatcgtaatggaaaacaaacacttaatggttcattaatcacctagcagagcttcttcgacaccaccaagtcatacaaacacatcacacggcaccaacgtactcatcatgaagttactcagccgccataaccacgattagggacattactgaacttataagttcataacactagctcgcgcaatcagcaccttggtgctcccgctatggacaaagattcggcctcaagccctccagactggcccaacatcaactcataggaaatcataactcacccctcgatcggggaatcatcagccatcaaggcaaatataatattgggcgctcacgggcgcatacaatcgtgaggaaagaaatttcgagagttactctttcaagctgaatcaagtacgcacgataagaattccaagaatgtgaagtgttttcctaaatttctgtagcctcccgtggatatgatacggacgtctacgtaccgatccacaagaccctactaaaccggctcataactcgtgaggcctagcaacctaggctctgataccaacttgtcacgacccaaatcctggtcgcgatggcgcccggccgcaaggctaggcaagcccgaccacaacaatccaataacggcaattacagcccaacaagaagcaagttccagatttaaaacacatttaatatatcaaaccgcccagtcagggccaagacaacatgaaagagatagaagaattcaacaacttttcccaacatcaagggtcacgagtactgagcctctaccaaaacagtatacaaatctggaatatgagaaatacaatgtctgaaagactgaaagaaagacaaggaatcggagaagtgggtcctgcggacgcaggcaactacctcaagtctccgtctatccgacaatcagcaacactaagcctcaggagcacctgaatctgcacacaaggtgcagggagtatggggtgagtctccaactcagtgagtaataagcatatataaaaacccgaaagcaggaaaaacacagtaaagcacaaggtaaagttatctacacagtttcagtcagaacagttccaaatatatccagataagcaacagagaatatgagtatgaatgctatgcaatgcaatgcgcatgtccgctacggtacgtgtagcccgatccatctgggtacccgcgctcactgggggtgtgtacagactccggaggggctcctacagcccaagcgccatatcataatattgctacggtacgtgcagcccgatccatatcataacaacaccgctacggtacgtgtagcccgatccatttgataaatataccgctacgatacgtgtagcccgatccatatgagtgcaagatatgcatgagagtcactaaaccatttttcttatagattttagatcccatttataatgaaaaccatgttcaggtcacataacttcaggaaatcatgatctatgcaagttaaacacaatgaagatacacagaactgagttcaaatattaagcaaatcatgctagtacggtcatatcgatccctgaaggatacctcaagttggcacaaggccccaaacgtggtatcaagcccagatatcatcaatatagaaaagcgaagcaatcgctaacacagtaccatttatccctcggattgggaccgagtcatatttctcaacacatacgaccccgcactaccctggagtgcgtgtctagctcacaatagcgtcaccatgtggtaaaccggggtttcggaccctcggataattatctacacccattactcacctcaaaccggccggaaaactagcctgaaatgcctttctccttcaaattcacctctccgagtgacgaatctggccaaaaccacaacgaatacattacataatgctaatggcacataacccaatcgaacgaactcgaaaaacaactcaattcgcaaaaatagcaaaactcgagccccgggcccacgtctcgaaaaccagaaaactttataccaaaacgaccctcgactcgccacgagcccatacatataaatttcatcaaaatcggagtccatatgacccctcaattcttcaattaaagtctagttgggtttcaagccctaacctccatttttagcttcaaagaccttgatttctaggtgtttaattcatgacttagcaccataatcacatattagaagtctattgaatcttacctgatgaattcccttggaatcctctccaaaatcgcccttaaatcgcctcagtccgagctctcttttcctctttctatttgaatgtttaaaccctctgatttcattaaagactgctcgacttccgcttaagcggtccatttccgcttaagcggtcaccgcttaggcgatatttcttctgcttctgcggtttccttcaatatcccagcggccgcttctgcggtcgcttgaccgcttatgcggtcccgcctacgcgatcccaaaatctgctcatgcagtacctgaccgcttctgcggtccttcatccgcttaggcggacacgcttaggctaccccacttccgcttaagcgaaaataccagaagcagcaggcttcttttaagcttaactccaaaaatctcccgattgaccatccaatctcaccccgaggcccccggaacctcaactaaaaacataaactcactctaatacttcattcaaacttgctcgggcaacaataacacgagcttaaacatcattaatcatcaaaattaccaaatcaaagcctaagacaaccatgaacttcccaaattcccattcgatgacgaaaccatccaaacgaagcccgaatgatctgaaaatttgcaaacatactcaaaatcacctaacggaaccaatgccactctcggaattccattccgaccctcggatcaatttctcacctaacaaccgaattcttctgaaatctaatttcgccaaacttagctaacttccacaccggatctccgaatttacttccgttttcactcctaagtcataaatcaactcccaaaactagtcgaaccatcggaaacccgttccgagccctctaactcacaagttaacttccggttgacttttccaacttaaacttcccttaaagagactatttgtctcaattctaaccaaactcaatctgaaacacttcaatctccccaaacacgtataataacacatgaagaagcataaaataggaaaaacgggacgaaaatataagagacgatggatcggatcgtcacataaaactaagttaacaattaggacaaaaaagataatctcgacaagctttaaagtagaaatctttgtacaacattgcgcattgtatcttcatatgattccttgtatactcgaccggattttcttgatctcgtagcaacaaacatgtccttacttgatggttcctcagaagtttccttttttgtttctagttacatgaaagtcagcataaaaattttaccaagtaatgttaaaaagttcatattaatgaaaaataagagaaaataccaaaccatagcagtgtgtggattctttaacttttttgcgattctcagtattagtttttgaagtttgctgcaacaagtaagcttttacgttaaacatctaatacatttctgccttatgcattttgataatctaaaaagtgttggacacgaagacaagacaaggaatgaacttcaaaagaattactcattctctttgtccaaaatcaagtttactgtgtctataacttacctgagctttatcagacttccagtattcaagaaggtacttaaactcagattctgaaacatatgaaggctttttttccattcgaagtttgtcattggcataggcgtcatagaatttttttcttcaaccaacacttataccttctccaagcattttgaattgattgaaaaacccactctcttccatcatcatgaatgtcatattttgtctacagtttggtgtacttgagttagagcaaaaatatgaaatattatcaactaacaattgatacaatgaaaacttcaaaccttgatatatgtccacatatcctcttttgtattcagtttcttccagttatatatatttagaggacaaaaggttgaatttcttgccaatgtaccgaggaaacttcccaactcttttacaatttcgtcagtaggaccaatgggttggttcaaatcacttagaacaaccaacttgcgctcactccgtccatgtacacgtggcatctatgtccttcctctttttcgttttacagtggaagagcctgcaatagttacgaacaagagataattaccaaatcactaatgctaattgaatttatgattgaaatctatatattcttgcctcgtttttctgattgttcaattacttcatgagtggcagaatgttgcgacgtttgcggcacttgttccaatactacatctgctgtagaagatgtagaatgttacgacacttgctgaacttgttccaatacagcttgtgcagcagaagctgtagaacgttgcgacacttgctgcacttgttccagtactgcttgtgcagcagaagctgtagagtgtagtgccgctcgatgcacttgttcttgcccttttgttgctacaggagagctagaatcctatggtacttgttgtacttgttcttgtactttttgtggtacatgagaggtacgtggcaattgacaaactagtttttgcacttgagatcctaaccttggatgctttggttgtctatttgaaaaattaggtggaacaactcttttggttgtaaacaacgaaaacttttcttttgccaacgatgaaagtgatccagctggaaggtactgtgagtttgtttcttttttgtttttccttgtagtcacttcttgattcatagtcatctcaaaactatcaagttaacaaaaaaaaagattagcataagtagttaaacaaaaagaaaaaactggccagaaaaaagcacgaatcaaattacaagaaacaaaattaagcacacaaagaattgttgtgaatccagttgtgcaagcttatgataaggctaatgatagagctgctgttggtttgtcatctgatgcaggcttacgaagttatgaattgctgaatgaggaggaattacctgggctcaaggttagtaatacaggagtagtgtctaaaggagctgggaattttgataatgcccaagagcagacagcaggtgcattgaatgcaaatgggaaatcaaagtttcatctcgaatctgtttccataatcatctatcctaagtgttattttttcttcccatcaactttctggtttctgtccacctctttaggagcaaatcgataacagtaccagcttgtagagatttacaacaatgggctaataagacatggaagattccagctggtattgttgttaaagaagtaaactgtgaatactttctatttgaatttccagaatcaggttgtaaagtggctgggaattttactatgaatgcaacagtactaccacaagatcaaggtgagcaggccattgctcttttggcaaagtctactgatctaacgatggacatagctgcagtcacaattggtaatgatatggttaaaggagctgggcagacctttgaagcaacacacagcacaaaatcaggaggatggacagtggtacatcgacaaaatacttcgataaataatactgatgctacagctataacatcacacctaaactcaataaagatagttaacacctctaactcttttggtgttttggagaatgaaccaatcacacaggtcacagatgatactggaaagagggtgcagcagcctcaacatgaggaaacaccaaaaaacagtgcaaagcagaatcaaaaatcagaataccccaaataagatcaggcaaagaatcacattggaactcatgtacatataccctcaaaattgacagatgcacatatgtgcacagcaactgcatggaagatttgcaaggaaacaaagcaagaatttcagcatggaatgcagatcatatgttcaaataaagcgatgtcactcaaaagctcttagacataaaagtattcagaatgacatctggacgggtcacaatggtaagcaaaggagcgacaatgcagaaaatggatataaaactctgcaaagtcaccaaaacaacttcaattcagtaaaacagtagtgcacaacttgtgcaaaaaaaaaaggcaggccaaatagtagcttttgcagcagtaatttagtgctggaactattcaaaaggctgccagttcttcagcagataaaagggaagaaagatgatacaaattagtgaaaaaactgaacaaatcaacagctaccaagcagttcaatatctccgaagaggataattttcaaaacaagtataagataataaacatatgccaaatgaattcaagaaacaaaaccaaaacttttatctttttttttcctgagtttatgacttaacaaatgaagataataacaatgtgtaccttttaatagatcctaatctgttaacagtaaagtcgcaactctcctcaatgatacactagcttcttcaaattgggttttgaaaatcctgtaaaatggatcacaattaagaattaaattctacaaaaaaaacaaataaaaattaattgcaaaaagtataaacaagaataatcataaaatattttgtaaaagggaatttatcactcactcaaaaaatattaaaacaacaataagtaatatatttaaaagtttagaatatcatttttttagtcatccggctccatccaatcccaatcagtatcatcaaacgcagtttcatcttcctcttcttctgatgtttctttatttgtatcttgtgaacattgtgcatatgatggaatatctacgatatcaacaggtacatcttctcttgaccatctaacatcaacatcaagtaatccacttgaggaacccatgctatcgttaggttccctccaaaatgtgtcttctatgttgggacaattcccttcctctagatcatacaaatcaatagggacctttttttcttgcataataaacatcttcctcaattggatctaccacataaaaaacttgataaacttgagatgcccacacaaaagaatcatctgtactgcataacttattgaagtacacccgagttaacccatagtcatcaatttcattctgataccaatcacacctaaatagtacaacactaaaaaaaacccaataatcaatttcaatgatatcctggatagctccacaatagataacctctccatcaataggattttggtccctagcgctagcaaaactatcagttgttgccaataaagtcactccactattttgagtctttcctgaagaatctcgtcctatggtatgaaatcgatatccattaatgaagtatgcagtatatcttttggcaacaacattaggccctttagctagccaccgtaaataatctggcacttcaatatttttaactttttctttgaaacagttgctgaattcccgactatgattccttgctcttacccatgcatttgatctagtatgattacccattaaatttttatgttccctgcaataatgaatattttaaattcaattattaggccttcataaatggagcttaaattatcttatcataagaaaataaataaagtttaaaatataaataaatattatataatttatcttacttaataaaattttccactagttcatctccagtattgaaccaagcatatcgatgtgcttcataagataactgtgaatccatgagaaaagtcttgcctttttttctcttcttacctccaattggatggccaatcttagggaatataggtgataaatcttgagggcattcatcatcctcagtttggtacctactgaatctagttttcacgccatcatgtaggtatctcgaacaaaaagtcaagcactcttcgactaaaaacccctatagagatggagctacaatacaactaacgggttctggttgatcgaactcagtaacttcgatcgaaattcgatatatttattgtaataaaattattaaatatgtacaaactattaatataaataaaatatatgtacaaactattaatataaaataaaataacttaaagagactaaaaatctcgaaccaaaaaacttcaaatttcggcgtcacctctaaatatccaaaccactctaaattatcaaaaagggagaaatgaacatccaaaccactctaaattatcatattatttgcagtttcttctagaaaatttatcaaattgagcaataaaagtttcacgtactttattttgtgtctgttcctgaaacttttctccaagttgtctttgtaatatattttgattttctattataactaaattagaatggcaagacttacgtgatgttccaaatcatatatggtgaggcgattgactattgttccttatggagttttttatggtccaccaaaattttagggggttcgggttcggtcgccaaaaaataaggaatgctcatggcgagatgatgattattgatcccttggtcgttttttatggtctgataaaatttaagttgttcgggtccatttgcccggatacatgcaaatggtgtgggttatagcacaaaaaaatctaagaatcaggcagaattccaatttcatggccctaaaatatcaaaaaacctgaaacgttcgtggcgaggcgtttactattgttccttaggttgttttgatggtccgatagaattttaggcggttcgggttcggtttcccagatgcatggcaaggctatagcacactaaaatctagaaatcagacgaaattccagttttatgaccctaaaataccaaaaaagaggaatgatcatggcaaggcgatgactattattccttaggtcatttttggtaatccatgaaaattttagacggttcgggtccggtcgcttagatgcacacagatggcgtggctatagcacacgaaagtctaggaatcaaatggaattctagttttataaccttataacacggaaatcaaccgcctcgactcagacacttggtacgaagacgtttatcccacatggggtgatgagaggttctgaatttgtacacttttgtatgtatatatatttttggctatggattgtactggagcccgttcgtgggggtgaatgtaaatgttttttgtttgtaatataaatttatttatgtcgcttcatctattttttgcttttcccttcttgggttttttcataatacttagcctccgtagagattgattttattactcgttaaaaagggttttgtcgtggttcgagcaaggtcgaactgatgttcgacaaccttggcattaggatgttgctttgactgtcgtcgaaatagtatctgtcgtagttcgaacgaggtcgaaccgatgttgttggccttagccatttaggatgttgcttcaactgtcatcgaagtaatatctgtcatagttcgaatgaggtcgaaccgatgtcgatggccttagccattaggatattgcttcaactatcatcgaagtagtatccgtcatggttcgaacgaggtcgaaatgatgtcgatggccttagccattaggatgttgcttcgactgtcgtcgaagtagtatccgtcgtggttcaaacgaggtcgaaccaaagtcgatggccttagccattagggtgttgttttgactgtcgtcgaagtactatctgtcgtggttcgaacgaggtcgaactgatgtcgatggccttagccattaggatattgcttcgactgtcgtcaaagtagtatctgtcgtggttcgaatgaggtcgaactgatgtcgatggccttatccattaggatatttcttcaactatcatcgaagtagtattcgtcatggttcgaacgacgtcgaactgatgtcgatggctttagccattaggatgttgcttcgactgttgtcgaagtagtatctgttgtaattcgaaagaggtcaaaccgatgtcgatggccttagccatttacaatgttgcttcaactatcgtcgaagtagtatccgtcgtggttcgaacgaggtcgaactgatgtcgatggccttagccattaggatgttgcttcaactgtcgtcgaagtagtatccgtcgtagttcaaacgaggtcaaaccgatgtcgatggccttagcgattaggatattcgttcagtggagattcccgttcgtagaatggagatcaacttttgttcgtataacggagatttctgctcatacaatggagatttctgttcattcaatggatatttctgttcatacaatggagattaactagtatagtcccttcattatatcgtcctagagatcgtgtcgactggctgatgtgatgaatatgatgaatatacactctgataccaccgggtatccccttcgccgcctagttataaacctccctaagaaaacccaattgggacaaaactctagtgagggaaaaagagtatgactcttcagaagttgaagtacttgaggtgggtaacattctagttgttttggagcggttttccctccgttgtttctagttggaaacctcctttcttttcggctgctacgattttatacggtcaatcccagttggttcccaactttccctcattcgggtctttcgacgctagtgttttggctttgaggacgtagtcgccgactctgagcgatcttactttggcttttttgttgtagtatctttctgcctgctgtttttgggctgtcattcttatatgagccatgtctattcattcttcagcttcgtgtatgtcctgcaacctactttcgtcgttgtctgccccgctggtatgggaatatctcaggcttggttcttcgacctcgacgtgtatgactgcatcggtcctgtagaccagtgggtatggtgtttctcctgtgctggacttgggcgtagtccgttatgcccatagtacttcatgtagtaattcgggccatagccccttagcttcctcgagcttctttttcaatatgttcggtatttttttgttggaagactcggcttggtcgttagaggcaggatgatatggagtggagagtatccgcttgatgtgcctttttttgaagaactcagttgttttcctaccgatgaactggggcccattgtcgcagctgatttctttggggatgccgaaacggcatataatatttttccatataaaagcgatgacctcttgttcgcgtatttgggcatacgcacctgcttccacccatttagagaaatagttagttaacactaaaagaaagcgtacctttcctcgtccggctggcaaagggccgattatatccattccccattttatgaagggccatggcgaggtgactgaatggaggagctcctccgcttggtgtatcatgggggcgtacttttggcactaatcgcatttccggacatagtctactgcttttttttcatggtaggccagtaataactggtgcggatgaggcatcggatgagggcgcggtttcctgtatgggcgccaaatggtcctcgtgcaattcttctaatacttgtgttgtttggtgcggtccgaggcatttagcgagaggatcgccaaactttctcttgtataggtcctgatttatcaggttgtatcgggcagcctgcacttagagctcattggcttcttttttttgtgtgggagtgttccatcctacagataggatacaaggcggtagcgccagtcccaagttaagtttaaggagaatacctcgacgttgtcaacggccgaatggaggagggcaaccacattttctttgttgatattttaggtggccgcggttagcgttgctaggccctctgcatcgatattttgtgccctggggatctgctcgaagagacattcgtcgaactaaggaatcagcttatggatttctgattggtacttctatagtctcttttcttcgatttggtaagtcccggtgacttgatttacgacaagttgagagtcgcagtggaggatgagtctccgtgccccgtatttgagtgctaatttcatacctgcaatcacatcctcatactcggcctcgtttttagtcatctcggggcatcgtatggactggcgaatgacttcacccgtagggacttcgagaatgaatcccagtcccaatcctgaggtgttcgaggcgtcgtcagtatagagggtccagaggtcggtatgggcagaggcacgaagggcctcttgttctgcctttggaaatatctccacactgaagtcggcgacaaagtcggcaagtacctacgacttgattgcaattcttggatgatacgttatgtcatgctcgctaagctctatggcccccttggcgagcctactcgagagttcaggtttatgtaggatgccccttagggtgaaggttgtttttacttttatgggatggcattgaaaatagggtctaagctttcgtgaagctacgaccagccagagctagtttttcaaggtgtgggtacctcgtctcagcatctattaaggttttgctgatataataaacatgcgattgagtacctttgttttcacggaccaagacagcgctgatagcgacttcggatactaccaggtacactagtagacactcgcctggtctgatttggcgagtactggcggcgagtattgatatgactttaatttccttagggcgtcgatgcattcctcgttccattatagcccatgatcttttctcagtacactaaagaacttgtggcatctgttcgaggatcatgagatgaaccttgatagggcggctatttcccccgtcagttttttacctgcttcttgctgttcagaacctcaggtattgtgtctatggccttgatctggtccgggttgaattcgatacctcgttgtgacacaagaaagcctagaaattttcccgaggccacgccgaaggcacatttttttgggttcaatttcatcccataccgcctaagtatctcgaaggcttctttcaaatgatcgatatggtcctccttctttgccgattttgctaacatgtcgtcgatataaacctccattgtcttgctgagctgttccttgaacatcttagtaaccaacctttggtatgtggctcccgtgtttttgagtccgaatggcatcactttgtagcagtaagtcccttggtgggttttgaaagttgtcttttcttgattctcttcggccattaggatttggttgtagctggaataggcgtccaagaaatgtagctgttcgtgccctgcttttgcgtcgatcagctggtcgatatgtggcaatgggaaggaatcttttggacatgccttgttcagatcggtgaagtctacacacattctccattttccatttttctttttaaccatgaccacattggcgacccactgggggtatttcgattctatgatggaaccgttggctagcagtttgtttacttcttcactgactgcctcgttgattatggcattgaatttcctcttcatttgccgtacaggcggataaagtaggtcgacattcagcttatgagtggcgatgtctttttgtatccctggcctatctgagtgagagaaggaaaatagatctgtatggttagttaagaattcgtggtacttacctgggtcggagaggttgtgcctgatataggccttctttgtgttgtcgttattctccagatggaccgggtcgaggttttcgaccgtcgctttgcatgcttctacgacatctgggtccctgatgacctcttcctgcgggttgattttagttcccgacatggctgattgctatgcttctgcgcttgctccttttaactgtttgatatgcgtgcagttttgggcgatccggtagcattcctaggaggtgcgtggctcgcctcaaatgctgaatattccccatggggtggggaatttgattacttgatagaagcttgagggaatagctcgcatggcgtgtatccatggacgttctatgatggcattataagttgtttcctgattcatgacgtggaatgtagtttccagcgtgactccccctgccaaaactggcagtgatatttctccggatgtccgctctactacattgttaaaacccgttagtgttatgcaatgcggtattatcttatcttcgggcctcatttgtatgagaactcccgggtggataatacatgcgccgcttctgtcgtctaccatgattcttttcacatcagtatcagtaatgcgtaaagttataactaaagcatcgtaatgagggaaatacaaaccctcggcatatgacttatcgaaggtgatactgtcttcgaagtcatcaaatcgttcgtgagcgatcgtacacttcaacttgtgtgtggtggtgaaccttacatggttgatcgccgagtcatcgccgtcgccgatgatcatctgtatggtgtgtgctggcgacggtggctttggcggtccttgggattggtctcgtcctcgggcgagatttgcccttcctttatcgctgagcagttctttcaggtatccctggttcatcattctgaccacctcttatcgtaagcctatgcaatcttcggtcttgtgtcttttttcctgatggaattcgcagaggacgttcgacctctttgcacttgggtctgatttcatcttttgtggccactgcacctttgtgcccatcttctctagtgcgtacactatttctgaagggaaaatacaaaagttatgggcagataataatgggggcatacctctttcatttcgaagcggggcgacgtatcgtgacacggtatctgaatgtctcagaggaggcggattgggagttctgacatagggctgattcctttctctgttgaagagcgggagttggtcccttcgcccgtcattgagtcggtccctccttaccttggattgtactgacgttagtcgctgggttggaccgttgagatcgtcttcatctgctcttacttcggcgcagtaggcattatgaatctcttcccatgtggtggggggatacttcatgagtctgttgagcagctttttggttgcctttgatccatttctgtttaacctgttttggaaagctgcgaccgccattccctctgatacatttggcagtcccattcttaccctgttgaatcgggccagaaagtcccggagtcattcacctgcagtttgcctgatggtgaagatatcgttgaccctagcttcggccttctttgctcttgcataagcaatggcgaatttgtatgccatctcctcaaacattgatatcgaccgagctggtagttgagagtaccatgttaattcccctcctgtcaaagtttcaccgaacttttttagcaacacggatggcacttgttctttcgacaagtcattgccttttacagcagtgacataattgatcaaatggtcttccggatccgtggtcccgtcgtatattttcaagtatggtggcattttgaaggtttttgggatagggtaaggagcagcttcctcactatatggttgcttgacaaaccttcccacatcgcgttttggcagtagcttagggtcgccaggtatcttgtcaaccctttcctggtgttctttcatttgatcacgaagcactttattctcattctccaattttttcattttcttaaggatggttgtgagtgtaccattgcttgtgtcgatgacggtgcgggtgttgctcgttcgtatagcactttgctcatcggtggcagcagcgatttctgccgttggcaaatcttccgtatttccctgagggggtttctcgagcatgttgcttagagcgctcatcaaccattcctctagcagcattttgactgctgggggtgtttcttttgccgcggacgtagaagctcctctttcatgcaagatcgttagatcttcgattgaagagggtgatatctccccctctggtacattacttggtgttacattctcgatattttctctaccagctttgttgaggaagtctatgaggttatttgagacatttgctatcatcttcaacctggtttctttcttcgccattgttggtttctatgtattatgaataacagtgatcattgttttttatatcctaggtgtgaactatgatttcgactaccgaaaataataaatcctaggatgatcttgataatcggttttgcaacaatagtagataagagagagagagagagagagagagagagagagagagagagagagagaggaagtattagagagatgagagagcaagagaacttgtatattaaaaatcctccctctattacaagacttggatcccctttatataataggagatccttatttaagtatcgaaatgacaagatcaaagcacgtcccatagagggatgatgtcgtccaaatccactgctcaaaagcaataggtacggtcgattgcaatataatttacccaactatgagtcggggtcgatcccacacagaacaatgtgtaggagattaggaatgtaagaaaattatcgcaagacacgcaatgccaaacactaagaacgttaattgaaaattattttatctaattgcaaaaatgtaaactaacctagaaagcaagtaaaatgatcaatggctacaagtgagaatgcatcgggaattacactcaagtaacgatcaaatgtatttcacgattttacaaatatgagcgagtttatgttaattagccacggataataattcttaattagcttcttccgaagactaacaagacttcctaattaaattattcctaatcacaattagaagattaagcacacccggaaggctacaagtagttcaatcctatccctaggtcgaatctataaaatgagggttaacgcctcaagttcttgttaattaatctttcccaaccccaaactatttttctcaaaattaattcggagataatgggcgagtcctatggttagctaatccctttggaaacactaaagaacaagaataattaaagtaacaataactcactttataaataaataaaaatcattcaatacataagcacaacaaagtattaaatccacactttaattatgaatatttccataaacaagattaagtattggaaatatatactatacacttaaatattcaatacaaagcaaggaaatgaagaaagcaacataaatagataagaaaatcttaaccacaagcttcaatcttcaagacccaagtgtgtttgtgcaagaaccctagctttctccttgttctctctagtctctatggactgaaaataagccaaaagatccctaaaatgtctgtttggacgagtacaaaactgatttggggtgagaaattatgaaatgtccattctgccacaggcctgatgcactgtttccgcatctgcggaacaacaaccgcagatgcggttccgcaaaagcgaaaatattatcgcagaagcgaaagtcttcagtaatttcataaaccgcagaagcggaccattaaacgcttctgcgcttccgcagaagcgggaaactaaccgcagaagcggaagtcgcttctgcggccattcttccgcagaagcggaattcactggaagtttttggcatgatttcaccttcttttgctcaattccacttcaattcaattctaatcacttcgtagcatcatttacctgaaaatctaataataaccaccataaacaacctcattgtataattaaaaggacataaaagctaaggaaaagaggctagaatgagtggtaaaatcaccactcatcaacacccccaacttaaagcttttgcttgtcctcaagaaaatcaaaaccaaaacttcaatgaggtttcaccattgaaaacacaagtggtattgccattatttacataacacattctccaatttaaacaccatactaatggatttggttggtactaacaattaggctcgagtatgcacatctttcccgaatgactccctcataaagaaaaacaacttcaagaatgtgcaaaggagttcaaaaataatcaagtgatcaacataagcctcaagaagtgactcaaaagcactagttcactaaaaatgcccactttactcaatttcaccaatctttcctaattcatgtgccctcacaagaaagaaagtcccaaaatcactatatttacaatacaacataagggacaaatttttcaaaaacactcactctcacaaagaacttcaagtgttacaacatttcataccataagctttcccttattttaattcatcgcttattcaagaatgctcggttgaggtcccataagggctttttaagcttgtaatgtaggtttagggaagggttggatagacatttgggtacaagtgacttcaccctccttgaacactactcacaattttccattcttttgcactttgctcctttttaaacccccatagcctcattttcatctagcttccaatatagaaccaccttacatacctcttctaatttttattcaagactccatactttatatacatacacatattttctctttcttttttttattttttatatacacatattttttttcttttggagcttgaataatttaaacaaacacttttgaggcatgtggtcctaaactcaccgtacaaccttacaaatctccacttcgataccacccccaacttaggcttttagcctcattctcaatgttcaaagagggacgggttcaagagagggaattatttttcaaaagaggcaaggtttgtaatgagttggccaaagaaaaggtttaaaggatcaaattgggtactagtggtattatttatgcaaaggtaggctcgaaaggctaaagaggttttgaaaataaaaacaaagaatgcctaagatcattcctccaaccaaacataccatcattaacaataaaaaaccaaccgggcaagttctagatgatagaagtaaacataagatttatttgaacaaatactaacacacatggcacatgaactaatcaagatgaatcaattttattttctaataatggcatttatagcaatatttaaactagtaggtaaagagtcactaaaagagccaaaaatttatcacaacaattattttgcaccaagcacgcacttgtttaagttcaacatcaaagcaccaaatttttggaggggtattcttaatttacactctacatacaagagactaatattattagtaccaaataatcaaaaagcctcatcctagcaaaacaagactaattcccttaagaaagttgtcaatctatccatcatcgggaaaagtcacccggttcagttcaaaagtgttccttgggaaagaaccgtagcatgaagaaaacccaaggaaattttatttaaggaaataaaaataaaagaagctactactactaaaaaaaatataagctattataaaagacaaataaataacgaaagcaaaataaaaacacaaactcgactaatcaataccaagcccggcaagggcacacaatataccaaacagcatagtcacaagcccggcaagggcatacagtatccataacataaacataagcccgacaaggtcacataatctcaaaatatgaatacagtacaatagccacccccaactaaaacattgcagtgtcctcactgcacaatatcgaatataaagcataaaaagtttgagggtctccctgaggtctgtatcagactagcagactgtgggaggacggctgatcagtgctgagctgtactcatagctgcatcatcctcggtctcctcatcatcatcattatcatcgccaccatcaccagcagactctgaaataaaggaatattcctcactatcatcttcggccgccactggaatctttgcatctggttttccccatttgaagatggatttgatgcctctccacatcttgatcatgaatttgctctttttcttgttcttcttcttctccttctgaaagtccgactgaaggtcagcatgggccttggccaaagtgccgtaggctccctccagtttggtcactgatgctgccatcttcttcatagaatcattctggcttttctgagcatccaagtaactttgcatctcgtccctggaaaagtaagaatgcccaggctgggaggatgagggcacactcggaagctgcgatactaactacttaattgattgaagctcagagttaagtatcccgaatggcccctgagaggctgactctgaacctgtggccgtggaagtgactttcctcttttttctctcgaccacacttccttatcctatcactctcaaaggatggaaaggtttgtcagctggtagccatcaatcggtggtacggacggcaacatctgctctggtgcatagctttgtaatcagtgaggggaacatcatccccgcatccttctctctcgagtactctctcaagtactgcctcatctcctgcagaatgaagtatcccacattcacctgaatgccatccagaatgcatgctatgatcaatgcccgggtgtaggagacatcggagacatttccacacggacatactctgttgctaatgatatgcagccaccttttggcctcggcagtgaagtcagttgatttcagcccttttcttttgttgccccatttctctctcaagtgtggagggaagagtttggatacaagccacactccattttcacagtgatttctctcttgcgccggctccaaaggatagtttgggattcccagagtgtcattgattttctcaatcccgaacctcaccatctttcctcagatagtgagttgtgggtcgtcaaaattcatacgcctaagattggcgtaaaattccctaacccactcctcattggctttgcaaggagtggtgatgaaacaggaccatccggatgaataaagccgggcatggaagtcggggagcttttcggccaatttgtcctcaaggattcccttttcaagaatgatcttttttatggacgaggtcgtccaaatatcggcgctcacatgcagcagacatgaagcgcgactcatcgaaaggctcatcaatttcttcttgaatttcatggggtgatccgcttgggtttgggtccatttttaaattgaaacacctacaataattcaacacaagattagtcggacaatagaattatgttaagcaatttaaaacactgcaattgagccaaaaaattaggttgaacgggtccgggaagccatttttgcaaccctactatttttggaaatctagacagtttccgcttctgcagaatctgagccgcagaagaggttcctcttttgcggttttccggtcgcttctgcggttctgttattttggatttttcactttttcgcttctgcggaaggccgtccgcttctgtggtttcagcgttttcttcagtgaaattgcactgccccgttatttttatttttctttttcactttcaacccaatttttggcatcaaaactaaaaattaatgcactataatagaacatgattcaatggagactaaatttgtgcagcttcacataagattttcactcaagcattgtgtcgaacactttgcgagcgagttaaaatgaaaccttcttcacaaaaatcaggtactcaagacttcccatgatttttgtccaataaaatcagcacacacatgactacactcaaccaattccctcacctcttaaagctaacaacaagaattaaacataacaagaagaaacagaaaagaaaaatcaaacaagattaaaaaaaacattctgttgcaatttagcacatagagaatgtgaagtgagagatgagcattgagaagagggtttagaagataatacctgaacttgtgcaagaggaagaattatgagcaagcttcgttggatttttggagattattttgtttttggggagttagggcagggggaaacagtgagtagtgtttttgaacgaatgaatcgttcaaaattctttttacaattaaaaccagtccgattttcgcttctgcgggtttttacccgcttctgcgatttcgcttaagcgacaggggaaccgcttttgcagactgttacgcttctgcgattcattttccgcttctgcgggaccgcagatgcggtctaaaagccgcagaagtggttttaacagagatttgttggacagttttctgcagctactggttttgactctccggaccactccgacctattcaactcaactccaaaaaatctaaaacttggcagattagtcaaaaataatattctaagctattctaaaaaagaaaattttaaaaacgatgaaattttttaaaaaacgatgggttgcctcgcaccaagcgccgcatttaacgtcgtggcacgacgcaaataactttaccacttttctcgcaacttggatgatatgaactgggcacctagcttggaatcaatcttgtgaccacgagcgatgggggtggtaagttgatgatcgagccaatgcttaaattcttcattttgcactttttggctctcaagtgaggaatgtcattttgctttcttgtttcctcaaattgtaagatgtatggcctgagtttttcctcctcgcagtccttcattgattcatgtagttcaacttccgtatcaccacaccattccaatgttaaaaaatgcttggaatgtaacttcaaacctccaacttgtaatttttcttggattttgacatcctcttcttcccccgaactagagtcaatctcaaccaatattgcattttcaccggatgactctaattccatttttttctttgcatcactaacactcatggagtcggttggcggatgtttaattcttgaatcctcataataaagctcactttcttcctcggaattggactcttcttggctttcttccgcacactcaagttgttgggcatagggagcctcaaccaataattgcatttgatctttcaaagtgcggatatattcatcattgtaatttaagccttgtttcaagtcctcgagtgctaagttgtgcttctcctcattttcaagaatggtctccaacatgagcattattttctcattttgagcatttgggagttcttcttgattttgatcaagtgccaaggaaggattttcactttcaatatccaaggaagattcttggttttcattcacttccgaggctttttgagcccttgaagcttcgatcatttcatccatttgtgagtgcaaccgttgaagtgctaaatcattttggagactagtctccaaaaggtgttccaaggaattttgctccttctttccttcttcaagtagacactccaacatgagcttgaactctccactttggtcatgctcaacttcttccatttctatagctttataattctcatcaaaacaagtagaatcatcatagtaggggcttggggaagggaaggtcaaatatacataataatcccaatgacaattttggcaaccacacttatcacaaatactccaacaatggggttgagattgtgcgcacaatccacccccgggagaatttaaataattttgccatgagtgtggtcctcaacaataaggacacgggtcataaaagtatgaacaactaccatccgactaattattattatatgatgccatttttcaaaaataagaaaataaacaagaaactaacaagaaaaatttgaccaaggtaagaaaaataattacacaaatattcataagtttggaccaaagcactttcgcttacttctcaaacaacctaaattacgccaaattgttccccggcaacggcgccaaaattgatgtcgtccaaatccactactcaaaagcaataggtacggttgattgcaatataatttacccaactatgagtcggggttgatcccacagagaacaatgtgtaggcgattaggaatgtaagaaaattatcgctagtcgcgcaatgccaaacactaagaacgttggttgaaaattattttatctaattgcaaaaatgtaaactaacctagaaagcaagtaaaatgatcaatggctacaagtgagaatgcatcgggaattacactcaagtaacgatccaatgtatttcacgattttacaaatatgagcgagtttatgttaattagccacggataataattcttaattatcttcttccgaagactaacaagacttcctaattgaattattcctaatcacaattagaagattaagcacacccggaaggctacaagtacttcaatcctatccctaggtcgaatctataaaatgagggttaacgcctcaagttcttgttaattaatctttctcaaccccaaactattttttccaaaattaattcggagataatgggcgagtcctagggtttgataatccctttggaaatattaaagaacaagaataattaaagtaacaataactcacttcataaataaataaaaatcattcaatacataagcacaacacggtattaaatccacactttaattatgaatattcccataaacaagattaagtgttggaaataaatactacacacttaaatattcaatacaaagcaagaaaatgaagaaagcaacataaataggtaagaaaatcttaaccacaagcttcaatcttcaagactcaagtgtgtttgtgcaagaaccctagctttctccttgttctctctagtctctatggactgaaaataagccaaaagatccctaaaatgtctgcttggatgagtataaaactgatatggggtgagaaattatgaaatgtccattctgccccaggcctgatgcactgtttccgcgtctgcggaacaacaatcgcagatgcggttccgcaaaagcggaaatattatcgcagaagcggaagtcttcagtaatttcataaaccgcagaagcggaccattaagcgcttttgcgcttccgcagaagcgggaaactaaccgcagaagcagttttgaaatcttagtctgttccgcagaaacgggtattcaaccgcagaagcggaagtcgcttctgcggccattcttccgcagaagcggaattcactggaagtttttggcatgatttcaccttcttttgctcaattccacttcaattcaattctaatcacttcgtagcatcatttaccttaaaatctaacaataaccaccataaaaaacctcattgtataattaaaaggacataaaagctaaggaaaagaggctagaatgagtggtaaaatcaccactcatcacgggaccgacgatgttatgaagttgtttctcccattatccccaggtcgtccctctgtatcggttcgcggatgttcagcggtcggccgtgttgacatagggacgtgatcggtcaaatttgacccatacaatcagccttgctatgaaaagtactaactaattattgtatgtcaactaattgatataattaggaacatatatatataaaatattatggtggccaattaattaaatatgaagttttagtagtagtaaagtataataatagttttattgttggaagtataaattaaagttagtatcctcaataatctccgatgatatagctcgaactatgccttagtggcttgtgaattagacccggccctgcgtacattgacctacaaaccaaaactaaaaacaaagatgtatggcaactatatgaaagaatactaaaataaaataacttaaaataaagcgtgaaaggtatcttcccttttttttaaaaaaaatttttttttactcggtgtttagtatttattaggtcttgattaaaatcaggtttatgccaagaaattctactttgatggtaatatattctttaataaaagctatactatattcagaaatcaaagtcgaactattaattaagaataaaaaatagggaaattaccagctatgtccatttagaagtaacccattacaaaaattggccaattgataaaatattactaatattagccaaaatggccaattagctatttgtagcaaaaaaatatcaaatttttactttcttttgagtgggtgctattagaatagattgggtatatcttaaggagcttgaatctcagttttgggatgatttggtgaagttttgacgtggtttgaattgaaaattcgaagtaaaaactgaatatgaaaaaaaatgttacgtgtatcacactgtgtatcacatatgtatcatatttgtatcgattgtgtatcacatgtatatctgtgtgtgagatacatgcgtgatacatgtttgatacatgtgtcacagaagaattttttgacatcgatttaattatgaattttgatataaaaccagtccaaatcaaattttgtatattgacttatctatatgttttcaatgaatttcgactatacccattaaaaaattccttatttatttcaatttttgaaatattggctagaggttggtaagttgaaacttatatgggacatttttgtaagtttccctattaaaaactctactctttctcatatgttacactccaaaccgattaacaaaaacttccgcattgccagccgcaaactttgccattttcctctgtcctacatcaacaatttaacattgatctttgcagatttagccactcaagcgcatttcgatatgcactctattcagttaccacttaattatgaatttcttaatggctaagatcgataacagagaattttataaaattgactcttttaccaattacctggggtactgtctaaagcctttttgagatctgctcccaacgggttgtccactggctgtctcttcctccatgcaaattggagttatatataattattaccacgttcgtgtttgtaaagaaatgcgtgagttatatggaatattcaataaattatagactactttaaatttttattttgagagggataattaactctgtggaggcaaaaattttaccgaaaaaaatttaaaaaaataaataaataaatatatagtctaatttcccaacgaaggaaattcaaatgaaccccttcttaccccgctccgtctatggccacacctaaagccgtcaatatgggcttggccgactcaactcaccccgtaatttaataggcttggataaagatttttggagcccatttaaaaacggggcttttaagcccgatccaagtaagtccgtggccccacgaggcttgaccgggggggcgaatggcacaaatagccactaaaagcagtggcttttattttaaagccactgttttcaatgtatttagactttagccattcctttaataaacttataccagaccggacgaagatacccttatgctcatgtccttaacttcaggactacatatccttaacttttgaacttgaaactataagttaaggacttgaaattcaaagttaaggcccgacaggacttgaaattcaaagttaaggaccgacagtcctaatgttttgaacatgggattataacttaaggacttgaaattcaaagttaaggaccgtctgtcctaatgttttgaacatggaattataacttaaggacttgaaattcaaagttaaggaccgtctgtcctaatgttttgaacatgagattataacttaaggacttgaaattcaaagttaaggcccgacgcgaaagagaagaagaaagggtaaaattgtcttttctctattagtagtggctattttcgctgagcattataattagtggataaaaattaaagacacccttaattagtggctactacacgccatttttacccaatttaaggttttacaaatgtaaaagttaaactcattggttatctattttctaagtggataatatgattctaatccatatttgacccgtttaaaaaaattcgttatccaacctattttttaataaataatatgggtggatgattgtttttttaaaccattttggcaccactaatggtaatcaatacagcatcacagttcacatcagtttaaatactagttctagtgaatttgacataaattttcaagaaaagggatgtttttttttgggttttccatccggtatccggtacccgtattggaacccgattatatccggattcgcaccggatagggccccattcggaaggtagcgctccctatcaagaatttttccatacccaggactcgaactcgaaacttttaattaagagaggagcagcctcatccactgcactttctttggtggtgagaaaaaggatgtgatactgtccattggacttttaggtgcatatctaatcccctttaagaaagtagggcatcttgattgttgttttttgttagaagaaaacagtgtgacaattcacataggaagcaacacgtcaaagggtaccatttatgacaagtcaatcaatactcgagatgcctcattcatttgcatttgtccacttgtaaaagccatgttgctattgatgttaactctctagaccttagatggtccatgtgtaacactctcatgtcacgacattgcaagatccaaatcattgatagttgcatctctgttgagattttttctctgtatccaaatcatcgatagtcctagcgagtgataatttgtttggccaaatttttaaagttaaaagtattttgaaaagttttttttttttttttttttttttataaaagtgattttcaacaaaatattattggtgagaagtaatattttggttaattaatttgaaaaataattttgagcagcaattactgcttagctaagtttttaaaaagtgattctaagggcatccgcaacctttatgtcacgccccgaacctgggggcgagaccgactgcctcacctaaccttgcgtaccaacttgcgactaaaagactttgaatatataatgtcatacattgtatgttcaaagtcctttagtcgcaagttggtatgcaaggttaggtgaggcactaggtgtcggtctcgcccccaggttcggggcgtgacaaacttggtatcagagtagttctgtcctagggagtctacaagccgtgtctagtagagccttgtttatagatgtgttgtgcaccacattatataaacaggggactacagggcatttaggagttggttacctttctttcaaatctaaatcgtgctatagaactgagttataggaaatttgagttaaacttacgtattggtaattgcatgcacagatgacggtgactaggaagactacgactaaccagagaagagatacaacagctggtgaggggaccaggagggtacccccattagatggggcccagtctgaggcccaaggtgagacccctactgagccattaccggctcctccaccacctgaggagattcatagggagaccgcacatacagttccccttccacttccatcagatcaggacttgaggagtgcggtgcatttgttgacacagttggtagctacccagcagcaagctaaggcatcagctagtgcaggatcttctgaggggtctgggagtttaagggtccgagagtttattgctttgagtcccccagagttcacggggacagatcagagggaggacccgcaggatttcatagatcagcttcacaggatctttcgggttatgcatgccacggagaacgaagcagttgggctagtagcttttcgactctgagatatagccgtcctttggtatgagggatgggagaggtccaggggacgtgatacacctccaactaattgggagaatttttcagatgccttccttgactagtacttaccacgagagacccgacaagctcgggtcgatcagtttctagccctcaagcagggtaatatgagtgttcgagagtatagtctccgttttgactcattggccagataacaccacctaaacataacttaagctctcttcaagggtttcaaagagaattagcatccgggtacaaaatcaagaagcgataatactagaacgatccctacgacgtaagtatcattataccgcctctctttttatttgtagttcgagttttgtaaggtacttcatagttaagaaatgtctaatgtctgtatttaagtgtttaaatatcaaggaaggttgataaatttattttctaatagttagaactcacgggacagtgatcggaaactgtgagttcgagttatttgacttgtaatggattgtttgtgggctgtttcgtgttggcctcttgtgctgatgttttatggagttttggaggagaaaaagtgtgggaaaaacaacacataatgacggaatggtaggctggttgttcgtcgttactttgttttaggttgtttggcactactttggttgtcgttttatatatgaagcgattagggtgcgcgggctattttgtggtacattgttacggagataaggttggaaaatgatgaatacatgttgttattgttgtgttcttgttgttgttggtatattgtaatgacccgacccgtcatttatttcatttcagtcccgttaccccgtaatatgcttccccgtgtgttggtatccgtgttggatgagtttggagtggttcgggtgaaatttagatagaaatgagacacttagtctctttaaggaaggtttaaattgaaagagttgacccagagttgactttcgggttagagggctcggaatggatttccgaccgctcgactagttccgggggatgaattatgacttaggagagaaaacggaatcgaatttggaggtccggtgtgaaagttatctatgtttgccgaagttggaattttggaagaatccggttgataggtgagaatttgatccgggggtcggaatggaattccgacagttgcattagctccgttaggtgatttcggacttgtatgcaaattttcagataattcagagatgtctaagtcgggtttttgatcgggtttgcattttgaaagtttaagttcattttgagttgaatccattgaattttgatgatttttagtgtttaaggtagtgattttatggcccgagcaagttcgaatgatgttttagaatgagtttgtatttttcgttgaggtcccgggggccttggggtgaaatcggatggttaatcggagcatttttggatttttggcagaaaatgggttctgtcttctggtgttttcgctggagcggaaaagagaccgcttaagcggtctcgcctaagcggaagaagagccgctgaagcggctggggccgcaggagcggaaaatgttccacaacagcggaaccgctgaagcgggaaaaggaccgctgaagcggtcgctgggatttcgaagtgaagaccgcaggagcggaaggatttccgcctaagcggaaccgcgggggcggaaataaggccgctggagcggaaatcgctggagattaatattggcagagtgttaaaaacactcattttagaagagagtaaagggagctcggtcaaggcaacttttagacgattttggggagcaaattgaagggattcatcaggtaagtcgaattagacttctattgtgagattatgatgctagttcatgatttttaacactaagaaatcaaggtttttagagctaaaaaatggagtttagggcttgatacccacaagactttaaatgtggatttgaggggtcaaatgaactccgattttgatgaaattggtatgtatagactcggggtgagacgagggtcattgtgatgtcaaaatttctggatttcgagacgtgggcccggggctcgggttttgcgaatttcgagaattgtattgtttttcgagttctttcaattgggttatgtcccattaacatcttgtaacatattcgatgtgattttgggcagattcggcattcattgggggaaattcgaaaggaaaaggcatttcgggctagttcttcgaccgtatcgaggtgagtaatggatgtatatcttatccgagggttcgaaaccccgtattatcacattgtgaagctactatgagctggacgcgcactccatggtagtgcggagtcgtatgtatgttgtgaattgcggctcggttccaatccgaggagtaaattatattgtgattagcgattgattcgctcttatatggataattttgtgggcggaatgccacgtttggggccatgggccgacttgaggtgtccttaagggactgaggtgattgtagtagcatgacatgctcattatacattcattatgcatcatttgcattcatatggatcgggctacacgttccgtagcgggatactcatttggatcgggctacacgttccgtagcgggaatactcatatggatcgggctacacgttccgtagcggaatatggatcgggctacacgtaccgtagcgagatatggatcgggctacacgtaccgtagcgagatatggatcgggctacacgttccgtaacggacatgtgcattgcatagcattgcattgcattgcatagcattcacttttatgcactctattgattatctgaggagtttcatcactgttctggttaaactgtgtaggtaactttatattgtgttttaatgtgttttcctgctttcgggttattatatatatttattactcactgagttggtagactcacccattactccctgtaccttgtgtgcagatccagggcatactcaggcacagtagatcttgtagaggacagctagtatcagtcaggagtgttgaggtagctgcacggcgtccgcagccatcaactctctttctctatgtccttatttcagtatttcagtgtatttccagcttaggatatgttttgtatcacagttattctatgtcctagaggctcagacttgtgacaccggttcctagggtgttgttgtgtatatttattttggtatttccagatatttggtatcgtattccaatttttatgcctcattaggcgacttatgggtattatggtcgggcttgcctagccttgcggccgggcgccatcgcgactgggattttgggtcgtgacacaccgcttccatgagtcatacacagtccaaaaatatagtaaaaacagtgatcatcagcccaaattatcataaaagggtatgtaagttttcaaaacgtatcactgtggctgagttttaccaaaatagagttttcaaacctttggactgtattcaaatataatgcgtatcatgataatgcaacaaatatatccctgaaggattctacaagtcggcacaaggccccaataatggcattaagccatatcaatccctaaaggattattcaagtcggcacatggccccaatcctggcattaagcccatatcaatccctaaaggattattcaagtcggcacatggccccaatcctggcattaagccatatatcatcagtataatacgcataacagatgctaatataatataatttatccctcgggttgagccgagtcacatttctcctctcatacagccccgcactatccatggagtgcgcttctcatcatcactatagcatcgcaaggtgatttaccggggtttcgatccctcatgtaatcacatacacccattactcacctcaagacggccaaaagtctactccgcgatgcccttgcctttcaaatttgcttcctcacgcgacgaatctgcccaaaatcacacaaacatcgatgaagtttgatttctaaaagacggggttgtaatccatatatatatatccgaaattcgtcctttaatgctactacaatgatccaatacggtgatgtaaattcaatctataatacaacatccaatagggccaatattggtaataaattccataacttatgccatttagacatattatcaaacaccttgtaggcatagatacttgcatctcataactatagtatttggttcctccaattatcaccattaaccaacaagttatctcaccatcgtttctaaccaatttataacttccaactacacatgtatgatcatccattcacacccaaccaataaaatttcatcaaataagcacctttaaatccctaccatgttcatgtatttaaattgggaatttatggcttccaaccaccatactataagttgtaatacttgattcatactcatattcccataatatatccatatatgcaagtctaaggtgtaggatttaccttttggaagaaatcttgcaaaatcctcctttgagttcttgaaggaattttcttgaaaatctaagtgtttgatgagaggatttcatcaataatagtataggaaatgatggaatttcacaccaagataatggagattacttaccttgaagattgggggagttgaaggtcttgagagggtgaaagaaggaccccaagttcgtccaaatgaaatgggtaagaatgaaccccgaaatgagtgttttaagctgagcattctgcctcatacacgcgaaacgcgcgacttcgcgcggtcttcgcgcgttcttcgcgcgcttagacacctgttcagtaaaatgatcataactttcggtatacacctccaaatgatgcgcggtttgttgcgttggaaagtagactcaaagggctttaatttgataggtagatcctcacgtaaatccttatataacaggagatatcgtcgtttaaagtgaggtcttgtgcacactcgtttacaattttcgtctattatgaaatttccaacttcaaaagttcccgttagccacccgaaatcatcccgtggcctccgagacctcaatcaaacacgccaacataacccataccattattataacttgttccattcaacaaaacttcctcaaacaacaccaaaaccatcaaattacatcgaactctctcttaagatcttccgaacttccaaaatacgtatttgataaaaaacccgaccaaatcacctccgaatgatatgaaattttgtggacacatctcaaatcacataatgaaactacagaaactctcggaattccattccgacttccggatcaaaatatcacttatcgaccggaaattgccaaaatactaacttcgccaaaataggctagttttacaaaaattcccatatcttgggcttggaacctcggaatttaattccgaacatatgcacgagtcccaaatttcatgacggttctacagaaattttcaaatcacgggtccgagcccgtttaccaaaaatattgaccgaagtcaactatatcaatattatacttgaaattcatcattttaaacacataattcaagtatttgaacatataaattttccggcttcgcgctcggactgcgcacgcaaatcgaggcaacctataaggaggttttcaaggcctctaaagctcgaaatggctaatactacaagtgatgaccctttgggtcgtcacaacaggagatgcctggatatgcaaagatgatgaaagacttgatgtctaggaagtttgacttccaagacttggccacagtaacacttacacagacttgtagtgcagtggtgaccagacccgttgctgagaagctctctgacccaggtagtttcactattccttgtactattggtaattttgcctttacgaaggcactctgtgatttgggggccagcattaacctcatgcccctggttatttacaagaggttgggcattgggagagctagacccacctctatgctgctgcagttggctgacaggactgtaaagcgtccttttggtatccttgatgatgtacttattcaagtggggaaattcatgttccctgcagattttgtaatcttggattgcaaagtggatgaggaaattcctatcattctaggaagactgctcttggcaactgggagagccttgattgattgcgagactggggagcttaagatgaggctcaatgatgaagagattatatttaatgtgcaaaaatcgatgagacgtccaagtgaattcgctaattgctctctcattgatgttgttgatgtaatcgttgagtccgatgatgaagtattgactgtggaggatcctctgcttgcatgtttaactaacttggagggagtaaatggtgaagacttggcagagtgggtactagcattagaaggtagggggttttgggaacgaaatctggagtttgaacccctacacttagaaaaatgagagagccctccagcgaaaccatctattgaagaaccaccgaagctggagcaaaagccactgccagctcacctcaggtatgaatttctgggccctaactccactttacctattattatctcatccagtttgctagatgtgcaggtgcaacaacttttacaagtgttgaaagagtgcaagactgccattgggtggaccatggcagacatcaaggggatcagccccgcttactgcatgcacaagattctgctggaagagggacacagaccttccagggaacatcaaaggagattgaatccaaatatgaactatgtggtgaagaaggaggtaattaagtggttagatgcggggatcatcttccctatctctgacagcagctgggttagcccagttcagtgtgtgcctaagaaaggtcgcatgacggtggtgaaaaatgacaataacgagctaatctctacgagaaccgtcactggttggagaatatgcatggattatagaaagttaaatcttgccacccgaaaagatcacttcccacttcccttcattgatcagatgctagataggttggctgggaggtcgcacttttgcttcctcgatgggtactcggggtacaaccagatctctattgcccttgaggaccgagagaagaccttattcacttgcccctatggcatatatgctttcaggaggatgtcttttggcctctgtaatgcacccgccacattccaacggtgcatgatggccattttcactgatatggttgaggacattatggaggtgttcatggatgatttctcagtggtggggaatttgtttgatgagtgccttgtgaatctgacacgcatgttgaagaggtgtatcgagacaaatctggtgctgaactgggagaagtgccatttcatggtgcaagaaggtatagtcttgggacaccgggtgtcaagcaaggggatagaggtagatagagcgaaagttgatattatagcaaagctccctccaccaacgtcagtcaaagcaattaggagttttcttggatatgcgggtttttaccggcggttcattaaagacttctccaaaatcgccaatcccctctgtttgttattatagaaagatcacccttttgtattttctgatgcttgtagggtcgcttttgaggagctgaaacaaaggctggtcacagcaccaatcattgttgcccccgactgggagcaaccattcgagctaatatgtgatgctagtgactacgcagttggagcggtgctgggccagtggaaggacaaactgatgcatcctatctactacgctagtagaacgctgagtggagcccagctcaattacacagtgactgagaaagaaatgctagctgtggttttcgcattcgacaagttccggtcctatctgataggatcgaaggtaatcgtatacactgaccatgcagctcttagatatttaattgagaagaaagactctaagccacgcctgattcgttgggtgttgctactgtaagagtttgaccttgaaattcgtgaccgaaagggcacggagaatcaagtcgctgatcatctatcacgacttgagggtgctgagaactcaattgaagttgaggaaattctggaaacttttccagacgagcaactgctcgcaaccaatcaccaggaagcgccatggtatgcggatattgccaattacctggccagtggtatagttcctcacgacctttcatcggtctagaggaaaggattctttcctgaaagccgtttgtactattaggatgagccttatctgtttaaaatatgcttggataacatgatccggagatgcgtctccgagatagaacaatcttccattttgtaggcttgttatgcatcagcttatggtggacactttggaggaataagaacagcagcaaaggtgctcgagactggatttttctggccgacagtgttcaaggatgctcatacatgggtgaaagggtgtaatgaatgccaacgcaccgggaatatctcccggcgccacgaaatgccaatgaacctaattcaggaggttgaagtgtttgatgtctgggggatagactttatgggtcccttcgtcagctcttatggaaataagtacattcttgttgctgttgattatgtgtccaagtgggtggaagctgcagcgttaccctccaatgatgcaaaggtagtggtggggtttttgaagaagaacatattcacccgctttgggacaccacgggcaattatcagtgacgggggcactcacttctgtaacagagcatttgagaagttgctggctaaatatgatgtgcgtcacaaggtagctaccccgtaccacccgcaaatgaatggacaggttgaggtctccaatagagaaataaagtgtgttgaccaaaacggtaaatgccacaagaactgattgggctaggaagttagatgatacactctgggcatacagaacagcttttaagacaccaattgagatgtctccttacaagttggtgtttgggaaagcctgtcacttacctgttgaacttgagcataaagcgtggtgggcactgaaacagttaaatctagacatggaagcagcgggcacctcacgagtcacagaactgcacgagcttgaggagttccgccatcttgctttcgagagcacaaggttatacaaggagaggatgaagcgactgcatgatcagaacattgtggagcgaaatttcaaagctggggacacagtgctactttacaactcaagattgagattgttcccgggtaagctcaagtcacggtggtctggtccatttcgggttgttgaagtctttccgtctggagctgttgaagtggctactgagaatgactctggcaaatttagagtcaatggtcagcgtttgaagctatacgtgggaatgagtgaacctaaggattgatctgcactgcacttgaacgaaccacaacggtcaagcgagccgtaaaatgcgctcatctgagtcgtgccgcgacattaaatcaggcgcttattgggaggcaacccaattgttaacttcactaacctataattgtagtttagaattatcagattttaggagtcacgagacttgaattgggtaggtaaaagcatgaattagacataaaataagtacatatgagagtcggggtgcaacccggaagctaaaagtcgaaaaaaggtgtgactctgagaaaagtggcctgtcacgccgcatggggcgccgcatgggtgcggcgtgacagtgcaaaacgggtagaacacgaaaaaagcaaggcctctgataaccctcactgtcgcggcgcatgggacgccgcacccatgagacgtgacagtgcaaatattttaaaaaaaaataataataaaaaaaagaaaaaaaaatcttttccagcatttttttttggtctgcccagcgacccccccgatcccaatcccccttttcttttcttttactcccttttctcttttcattttctctttctctctaaccacactaaaacccttaccccaatttcccccatatcaattcttcctcatctcttcaaatttcttcaccaacacacacactcgtcccctccattcacattccaggtaagttttctactttcttctcctttcttttagtatagtttaatgtaactcaactttaggtagtagcttagtattaatttcttttttaagttttgtttctcttatgtttttctccatgtaatggcctattttggccatgattggtgttaaattgttgggttggcctatttttaacttgtgatagaggttcaccatgtttgaagcctaaactaaaaatattgtgatagtgagttgtgcaagggccttaatggccgaaaattgtggtaaagttgtgaaaatttggagcaccttgtgtcattgttgtgttttggtgggcgtaggatgggtgattggtatgattgtgtagcaatgttggtagaattatacttgaattaatgaggtaaccttggtggaggtaatgtgtttgatgaaatgcctcaatgactttgaaagtaatagagttcttgaccaatatttgcaatgagaaagtttgtgcttgatgctaaataggaaagtcgattcatgctttgtacttgtgtaatattgttgtttagtagataatgtgtagtagtacattaggctaacttattttgtttctcataatagtcactaggttagcttcttatttttcttacattcacgtagcatagggcaaggttgtagtggtaccttctgttgatgattgggaaaattgttggattgcttgtggcgcactttaatcaggatagtctgaatccctgatatacattctacttgtgaacaagccaatgacataagtgtggggtgattcccccgtttagtatttgtggacttttcatgttatggcttacattgttcgtcttgtgcaggtataatgtctcgtagcccgagcaaacactctaacattggatcttctgagggtacctctagtagccgtcgtggtgggcgaagggcacctacccccgccctcgtaccggaggtagtggagcgtatagaccctgatgcggatgaggtgccagcgtgcaagtatggaatacaggctgtccccgctcatgctcgacggtggtttcagacttttgttctgtcagtcaacccagaccctgttgacgatgcaaagttggccaggaaatatggcgacatttacaacaacatccgggctttgggttttgaaagcatatttcgtccgggtgatgtggtgaatgtgaacttagtgaaagagttctatgctaactggcaacctagtgccgacctggatccagtgtacgagatgccgataaggggtaaagtgatccccttctcctccagtatcatcaatcaaatcatggggttcactgaacattcccacaagctgtttcatagattcctccgtcaaccagactatccggccattcgccacctgttatgtgggcctgattcttctgccgcgtggactcgagatgccaatgactttcacagagacatgaggaaggcaacgttccagcggccagccagggttctattgcggctgataaatgctaaaatcacacccacgagtagtgacaaagaggtacctcgactgaaggtatgcttgatttatgctttgttgactcggatgcaggttgaccttggcaagatcatgcttgagcacatggctagagtgcgaccactagggactcgacgtctgcattttcctagtatgagcactcggttgatgcggacgcacctcgtggaggaagagttccattatgacaggatcattccagtgtcgtaccccattaggccctttgatgtcacatcagtgactgaaccccctgctgtggctgttacctcggaccagaggatggttcgggttgaggagactctacaattgctgtttgctgacttgagcctgcgggctgatcggggggaggttgatttagaggagttgcagcaggagcaccctctgtccgctatcactcagcagtggttgggattggggggaggaggacaactgccacccgatgaggatgtgaactccgttcctgatgatgatgatgagtacttgcgcaccttcgagggtgctgatgtttaggccttgggcctcagggagtccctttttcactcttgcttttactgtttgcattggggacaatgcaatctcttaagtgtggggtggggccttcctatctgattgtacttgtactttcctttgttttccatttgccagttggttttgtttgatttatttcttgctttcttagacaattggtctgtaaattataattctgaattctatcgggcctgtaatagttagtaagtatgtagtttgactcttcccgacgatggatttcgtcgaccggattcttgagggaaatgagtcgaaacaaaaaaaaattcatatatgttgaaaaatccaaaaatatgtctttcattgttagtcttttctttttgagttaagtagtgtaacaattcccccttggtttttctttgtgccgcggttcttttctaagggtttttgcttgaacggggtgtagttaattttttttgttgtttaggaatcaggagtcgttagttagggagctaaattggaagatcaactccccttgattgcatgtgccttgagagtggtaagggccttagttgtgacacctaggctcgattcttgactcttaaatcagtaccttaaaattgtatgaccttaactttgcttaactgctttgaacagagtgtcgtgataagtctaatcctgagtgagttatgtgccatgtatgtgtaagattttgtgttattcagtgcattgcatttgatgcctagaacttgtcccgtgtgtttgcaaagcgaaatagtagttttgttcagtcttggaagtgatataggcgtttctttgttgagccatataaatgttttacccacctaattgttatgtatcatagttaacccctttgagcctataatcctgtttctttggcaaccacatttcaagccttaccatttgtttgaattatccatatatttgaaccctttcacctctcgtgagtacttgaattgttatgaacgttgcaaaagttaaagtgtgaggtggtcggtttggcttttgagtggagctagatgaataaggagaaaggtgcactgttttgaaaaaaaaaaataataatatataataataataataataataataataataataagagtcacttgaattgaaaaaaaaaagaaaaaaaagagagaaagacgataagtggtagctcttgacgtaagtgtgcttaaagaagaatgaggtaaattatattgtattgatgtgaatgtggagttttggtttgacataagtacatggtttaaatgttaaaatgtatgtattaaagtgcttacggaggtgtagtcactcttatatctaaatgtatcctacccgtcccatagcctacattacaaccaattaaagtcctacttgatcctagactgaatgagctcgattagtagagtagtacactacgggcaagcctatggtgcatcttttgtggcatatgaatgttatttctcagagcgagtgaattctttctatctaaagttcctgaatattcttaaatttgattgtgtggaactactctcttttgttgtgtgagggcacgtgattcatgaaggaacggaaattttattgacctctgtgttagagtaagtgggcgagtgattaatacatggtacagttgagtaaaatctcgaggttgggatgttatgataaggtgctcagtccgctttaattgttcttggcatggtatgtcagggagggagcttgatgaacggttatccccaggtgtagtgtagttcaacttgctcgaggacgagcaattgtctaagtgtggggtgttgatgttatgctagaaactcgtgttttagcatgaatattacagtccaacgagtgcatttttacgcgtgtttgagcttaattgataatgaattacacttattacgtattttatgccttgcaggaagcgatccggagattaatagttaatttggagctaaattgatcaatttgaagctttgaagtctgagtaaaagctcaatacattaagccggaatcatgttcggggtcgtgtgccaactctggatgttaaacgaagacaaaataggctagctctgagaaatttacactgtcacgccgcatggggtgccgcatgggcgcggcgtgatagtgcaatgtgcacctgtgaagcaaaagacaaggcggcagataatcctcactatcacgccgcatggggacgccgcacccatgcggcacgacaggccaaaatttatagagttgtcctatttcgcacaggaaagggttattttcgtccgggcccgaccctacttggtataaatacatgtaaaaatgctattttgagtacttttgccatattttagacctagagagaatatttacaacgtagttcttctttcccttttatttttatagctagattatgttgaatattcaattattgcgtttacccatagttatgagtagctaaatcctttgtctaaggtcttgatagaacctattgtgggatgaacttctagtttatgttaatataaatttgcctgttttaatctatatttattcaactatattcttgttgtagttaattgacaggatcctcaattagctgtgcttatttagtgtgcataacttggaaaagagtgcatatttaagtagttgttgaataacaccactcctaaagtataagaggaatctataactgcgggtttaaaggcgagattaggaataacaaagccttgggtgcaacgttaaatgaactgtattaatcaaaactagctagtgtatctcgggagagtgcaatagtatattgttgtgattattcggaagaaattcatgataaactaagtgttcattgttgatatagaactgttggtaaatttgtatgaagcataaacagaagggattccatcaatagggaaagtcttgaccttagcatctctctctcatattatttacaaccttagtagtttatttttagcttgttagtttactccaaatattagttggtaattaaacctccaattgtgattcgaaagtcttgggaagctggtttcgagaatttgagtgggtcttaaggtggtagctgataggttaactctctgtggattcgaccctgggcgtaatactcgggttttatttgcaacgtccgcagagtcctttttagaggtcatactttgggcgtgattagtctaccagtagtgccacgaggcccacgaccaccacccctactacaggctccaacactagtaggtgtagctggtatctcatcttccattcctatttcattatcttctattcaaaaatcctcttgtaattgttgataatctattatcattaggcgatgtttcagaattaggtattactattactactagatgctgaaggacaatctttttttttattttccctaccagtaactttttacacgctcttttagcagcattaaacatattgtaaaaattaaagtataagctaaaattaaatatgcaattaaaatagtaaataaaagaaagagttggggagagtgcaacgcatttgagaatgaaagaagcacttgattaagcaattccgatggtacacgaacaaacgtcaaacttcaattgttcaaagttgaaacttcaaacttcaaattccgagtgacaaaacacgataaattaaattcaagaaaagtgaaccaaataaaattagaagatgaaatgatgaattgaagtattgcaaattggagaatgagagaacttgagattgagatatgaaatttgagtgaagaaatgaggggggggggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaagggttaaaaacataaaataaaataaaaaatggccatttcttaaatagatccgttggccaacggatctgttctgataatatgaacaaataacggatagtgggccccatttgttttataaaattcaaaaaaaaaaattaccgttaaccgggccggtccgggttaaccggtttgggaactgttcacgccaaacgggttacccgggtccggttaaccggattcaaaacctaaacctaataaactcgtcctacccccccccccccccacccagcccatccggccccttataaaccgggctggttcggtcacagtttgtaccgatctgggccggtccggtaacgatctgacccgacccgtttgacaggtttacttagaaacatataaagagtcattgggtactaactaaagtacatgaaacttttattgctcaatttgataaattttgtagaagaaactgcaaataatatgattgcgccacccagtacactcctagctgttttttaattattctccacacttaaatagtgaatctgcttttttctccctttttgatagtttagattggtttggatgtttagaggcgtcgggaatttgaagttttgcgggttccagatttttagtctctttaagttattttattttatattaatagtttgtacaaatttgatagtttgtactattaatagttcattttattttagacaagaggggttgctctgatggtaagcaacctacacttccaaccgagaggttgtgagtttgagtttccccaagagcaaggtgggaagttcttggagggaaggatgacgagggtttatttggaaacagcctctctacctcagggtaggggtaaagtctgcgtacacactactctccccagaccccactaaatgagattatactgggttgttgttgttgtattaatagtttgtacatatttaataattttcttacaataaatatgtcgaatctggaccgtagttactgagttatactgggttgttattgttgtattaatagtttgtacatatttaataattttcttacaataaatatgtcgaatctggaccgtagttactgagttcggacagaacccattaattttattgtcgctccatctctacttgaattgtaaattcgtgggcagaattaaaagagaattgtaggattcataacatagaagaaaaacctttactctaaatgtgaagaaaataaacaattggaaacatattatcacaatatattgtacaacaaaacattacatgaccaaccatccctaagaaccgaatggcattattcatacttgttacaagcaagtctaaagtagcaagattattacatcttgtcactacatagtacgtacaaggttatatatactattggagtaacggtatatataacttaaactctttacatataatgatcagttgtgaggctggacttcggtgactttatccattgcctcacctgcataggaacaacaccttttgcaaccatggtaacctttcctgcagcaaccatagcggcatcctctgcgtttataaccaccaccaccgccacctccataatatccatcactgccaacgccattgtatctgctacgtccgtcaacgtgtacttcattctcgttatccggtttcattgctgcatcaattgtgaaacttaaaacatggtccgtttgaccataaaaaaaattctcttttttttttcgaaattaatgtttggccatgaaaatttcaagttttacttgaattgaatttcgaaatttttcagaatttgaaacataaaaaaactatgttccaaaattttcacattaaatcactcacaaattttttttaaaaacggctccaaatagtattcatgtccaaacattttgaaatacctatttctatatttactcaataaacaagttttaagttccactattcttattttacacgttttacttacatttactttctatccagtcaatttaagacacacaaaatgaagtagaaggagtacaaattaagagttattatcaatctatagtgatagtaaatacaaaagtgcaactcaactactacctcgatgtggaaatcaagttgagctttactagatgataaacactaatttgaaaggttaaataatgttacaacatgttaaaatacatcaatttgtacaaatttattgaagagtcgcatatataattagttaaatcatataccaaataatgagaaaaaagaatttattttttcagagtaaaattacaatgggagcaaatgaaagtaagcttacagttggaagtctcagccaattctgcagctacgacctcagagcttatcaggaaaaaaatagccaaaaaaaggccaagaaacagaaatgccttagaacccatattttctttctttgttcaaagcttagttatgatacttatgaaattaaggaatgaagaaactgatataatcttgggttctatttatagtgagatttgaatgcataaataaatgaaggaaagggtactacttgaaggtgtgaggaaaaatgtaccccgggccccggggtgcttaattgttgtggaccaatggatacaaaacagaggcagagccataatttgaaacttatgggtttaaaattttaatttttttttaaagttaataaattttaaatttattaatattcagtataatttttaagacaaatacataatttggaccaaagctactggattcggttgaacccataggttttatcctccctccgcccttggatacgaagaaacctggtctataagtggccggtaaagagaatgaagagagtcttgagaaatgggagaagttagagtttaagttatgtgtttgcccgaacgcaatagttttagttcaaattatgtatttattttataagaaattcattaaatatataaaaaatattaatttaaaatcccgtaagctaaaaggggtagaaactcaaatccataaattttaaatcatcgccccccctctctagaagagttgaactcacgcttattctcaaagaataaatttaaattctattttttttacgattacatgatttaaaagtctttttatttttcttaaactttgagccaagatctaaattgaaacgaagaaagtactttttatgcaataaaaagtatttttgatattatgtgggcgtttggacataagaattgtaaaatttcagggtgaaatttttttcaagtgaaaatagtatttgaaatttagagttgtgtttggacatgaatataattttgggttgtttttgatgttttgtgagtgatttgagtgaaaattttgaaaaataactttttggaatttttaaaatttttaaaaattttaaaaatgcatcttcaagtgaaaattaaaaattttatgatttcgaaaaaaagcaaaaactttttgaaaaaaaggaaaaatttcttatgtccaatatatatatatatatatatatatatatatatatatatatatatatatatatatatatatatatataatttaagatcacaaaagcatttcatagagaatcggaagagtcaaaccacgtgcaaggggttgctggcctacaaattaaaacatgagtgaagaaacagataatcaggggcggcccaacatattttgggcctaaagccaaactttaatgagggaccttaatgtttttttttttaattattatttgaagtcaatttttctagtttttttagatgcaaagtaactaataattttcttataatcaatttctcctaataagtcattctcaagataatataactaacccatttaatctctcttgagacattgttgatcttaggtaagattttatcaattttaattttgaaaaacttctttccactgaagcaacggtaacgggaattgttaacattattctataagcaatataggcatttggaaaagaatcaagtctctttatttgattgagtatatcgattaaactattatcttctacttgtactatttcccttaatactttcaacttagaaaataaatctaaaccatcaatatcgggttgattattatgctttaagaaaagttcaagattaaaacaatgtattttttaaattttcatcatctagtgatcttagttttttaccactaaatagaaaatcaaatatattttcgtacgcttcaaattgttcaaatctattttgaagtgataaaatagccttgtctactatgtataaaaagtaatcaactctaaaggactcttcaagagactttgagatttcattatcatcattctctatcaaattgtttcttcctagatatcacacgttttttacgaaattcgggttcgatattcatttcaaatacaatttccttggcataaatcatagcagttgcaaatccttcttctctatatttgttaaaaaagaaatcaaaccttttaattgatctatggcaacatcaatatgcatgtcttttaactgcatatttttactaactgaattaacatcaaataatatatcataccaaatagtcatacccaataaaaattcaaaattttagagttcatatgttactaagcaattagcttcacttttagtttttagatcatcactaatttctactaatttcaataaagcatctcttatttgtggagtttgaaatcttattgctttaatgctttcaatacgactttctcaacgagtttgtgacaatgatttaagagttagactgggtacactatcctttaatactttccatcgcttagtagaagatgaaaatagtgaatatatttgtaccactccaaaaaataatatagcttttgtacaagaattagccatatcacaaagtaacaaattcagattatgacaaccacatggtgtataaaatgatctaggatttacatcaagaagtcttttctgcactccttgatgttttcccttcatatttgacccattatcatatccttgccctcttaagttatcaatatcaagtccaatattttttatttcatctataataacttcaaaaagaacttttccacttgtatcatctacttttaaaaattctaaaaaaatattcattaatttttattggagttgctgaaatatccacactccgtagtataaaagacatttgttcttgatgacttgtctctggagtgcaatcaagtatgatcgagaaatatttggcttctataaatttttctattattttattcttaatttcacttgccaataagtttatcaattcattgtgtattctatgaccaaggtaatgactatgaatcacaagtatgataatagaacgaacaaaaaacactccactattttttgaatcaatacactgaactctaaaactccacaataatctttggctattgcaaaatagaggcttgaattgaagaacaaagtataaaaatataatatggaatagttcacacgtttttgttttcagtttgcttgagaatgttgtgacttgtgatagaaaagttaaaactttaaaataaaagttgtacttgtttatgtacaacaaccaacaacaacaacaacaacaacccagtataatcccataagtggggtctggggagggtaatatgtacgcagaccttatccctaccccgaggggcagggagactgtttatgtactacaaccaataagaatatattcctacctaattgattattttctaagatatcctccttaaagagggactctttccattcccaaaaggattatttctattcccaaaaagttagtaacgttggttcttagttcttaccatgtagtaattgtactttcagattttattttattttgaaaataaattactatgggtaatagaagtgggcccctcacattggcattcactatctcaaatttgtgttctctttttatgcaaacttcccacggtttcactttatagctttttttatttttttattatatatatatatatatatatatatatatatatatatatatatatatatatatatatatatatatatatatatataaaataaaaaatgggccccccataaatatggggcctaaagcggttgcttgacctgctttatggacgggtcacccctacaaataatggtaaaaatggcgtgtagtagccactaattaagggtgtctttaatttttatctactaattataatgctcagcgaaaatagccactactaatagagaaaagataattttacccttttttcttctctttcgcgtcgggccttaactttgaatttcaagtccttaagttataatctcatgttcaaaacattaggacagacggtccttaactttgaatttcaagtccttaagttatgcgtcgggccttaactttgaatttcaagtccttaagctataatctcatgttcaaaacattaggacagacggtccttaactttgaatttcaagtccttaagttataatcccatgttcaaaacattaggacagacggtccttaactttgaatttcaagtccttaagttataatcccatgttcaaaacattaggactgtcggtccttaactttgaatttcaagtcctgtcgggcattaactttgaatttcaagtccttaacttatagtttcaagttcaaagttaaggatatgtagtcctgaagtcctgaagttaaggacatgagcataagggtatcttcgtccggtcgggtataagtttattaaaggagtggctaaagtctaaatacattgaaaacagtggctttaaaataaaagccactgcttttagtggctatttgtgccgttcgccccaaataatgcagcagaagatgtcaaacagtcacttatcaattgacttatcaaagactcttcattttttgcctttcacaaattgcattcacagacgccacgccgctcaaccagtaaacatttgttcgtattcgacatttatatcaattaaattaaataaataatataattttaatatatttatttttaattagaaatttcgagttaagaataaaatcgcctttagtaaaaaatactttatctataaagagagacttttcggtgcaagttcaaattaatcgagttccaatttgatatgaatacctggtgggaaaatttaaaaatagcctgatttacaccattaaaatctggaaaaatttcagtataatatgccggaggtcgaatttttttacatatgagatttcagcattatgtgttggaatttcataatgtgttagagttccaacataatatgctgaaagtttatatgcatgaactccatatttcaaaatattatgatggatctttccgtgtttcagctaaagtattttttctatctaaattttgtctctacataaaataggctattttctcagaaagtttgcaaacaccgactagcccatgttatttttacaattcctgcgggtccattattcatactagtggttaaccattaattaaaccttgtccttataacacatcagtatgaccaagcggcttacgtacatctaggggtagctcgatataatttgtggctgaaagtcaaatattaatatgagttttttttttttttttttttttttttataatttctattttactttaatatttttataaaaaaaaatagaagaattaatccaaataatcgtccacctaatatatataataataataataataataataataataataaataaaataattgtatactataatctatgtatatcggttagaaaaagtccttcaattagtaactattattaaaaaatggggccctagaaaattggaagtataatagtagttttattgttggaagtataaattaaagttagtgtatagggtcaaatttggccctcaatgtccccatgctaatgggcacgccccaacaagcagacgttgaccatagcgagggtacggcccgggcggaggaggaaaagcgacgtcgtttagaacttagcttcttcgttaagctgaggttatctgcttttgtactttttttattatttcgaggaaggtctcctactatataaaggagacgttcacattgtaacaggcatcaagtattattatcaataatacaactctcagcttctctctctatctcaaaactctctctctgaaaccattattatctcgttgcattatcagatctacttttacattatcatcatctcttactctagggcatattatattgattacgatttacccttatcttctttcgattgtttttaagcttacaaagtatattgacaacttttgagccaaacaatttggcgccgtctgtggggatttcgagaatcaaaaccatagtttgcacctagaaaacaaccgacaaccaccttttataccatacgaacaaaagatggctgagaacaacacgagattgaaagtaataacagaggttagaaccgaccttatgggttctctcaacgaagccggtgaagaaggtattttgaatgcaacccctagcaccatattgagtggggagatcccacctcccccacctgaagatctggtgatttcgtgcgaaaagggtgcttctacatctgcaactaaagaagcaccctcggaagtcaagaagctactggaagggtggctaacaagtgctctaagtggcttagttgagaagtcaccacaaaacaacaccagatgcacaccaacggtggaccttactgctaccataggtgagcccgagattgtacgagcaaacgacatgcccatcggtacacggaccaatggtggcacgcttgcagccatcctcaagaagatggaggaaatggaaaacgaaaacaagtcacttcgtgaccagatgaaggaacaccaagagagggtagacaaaatccctggtgctcccaagttgctaccaaagcgcgacgtggggaggtttgttgaacagccttatacggaagaagctgccccatactccatcccaaaaaccttcaaaatgcctccctacttaagagtgtacgacggaactacagatcccgaagatcatctgatccattacgtcacgactttgaaaggcaatgacctgtcaaaagaacaggtaccatccgtgctgttgaagaagttcggtgaaacgttgacaggaggagccctgacgtggtactcccaactaccggctaagatcatttctacattcaaggaaatggcggacaagttcgtcaccgcccatgcaggagcgaagaaagcagaagcaagggtcaacgatatctttgtcgtccgacaaaccgcaggagagggactcagggacttcttagccaggtttaacagggtgaggatgagcttaccaaacgtatcagaaggcatggcggtggccgctttccaaaatggattaagtaaagacggttcgagggcaactaaaaagctactgagccatctcatgaagtaccccctgccacatgggaagaaatccataatgcctactgtgagcagacgaggacgaccttaacgggccgacccaacgattaacaataatacatccggaaatcaggagggaccgctgcatcgagggacggcgggaacaaatcccgcgtcttaacagggaaaggcaccagccctacgtcaggtcctcccatcctccaccaccaagacacatggacgcgctacagcgacatgttgcccctttccgaaacgaaagaggtatgcctcatttattatctgcccataacttttgtgtgtccccttcagagatagtgtacgcactagagaagttgggaaacaaggtgcaatggccgacgaagatgaaatcagatcccaccgcaaggaaatcaaacgtcctatgtgagttccatcaggaacgagggcacaaaaccgaggactgcataggcctacagcaggaagtggtcagaatgctaaaccagggatacctgagggagctactcagcgataaaggtaaaatcaactttgcacgcgaacatgaacaacctcatgggccaccgatcaacatgatcatcggaggcggcaacgactcagcaatcaaccacgtcaaatttaccaccacgcataagctgaagcggactatcacccacaaacggtatgacgacttcgaagatagtgtcaccttcgataagtccgatgccgacggtttgtctttccctcattacgatgctttagttatcactttacgtattgcagatacggatgttaaaagaattatggttgacgacagaagtggcgcctgtattatccacccgagggtcctcatacaaatgggactcaaggataagataataccacgctgcataacactaactggtttcaataatgcagtggaacgaacctccggagagatagcactgcccgtcatagtagggggagtcacgctggaaacaactttccacgtgatgaaccaggaaacgacatacaatgctatcattggatgcccatggatacacgccatgcgggcggtcccatcaagcttttaccaagtaatcaaattccctaccccatagggagtgttcagcatccgaggcgagccacgcaccgcacaagaatgctataaaatagttcaagattgcacccacaccaaacagctcaaaggggcgagcgcagaagcatagcaatcagctatgtcggggactaaggtcgacccgacgacagacgtcatcagagaccccgacatcgtggaggcctgcaaggccacggttgaggatctcgaccccgtccaattagacgacgctgaccctatgaagaaagcctacatagggcacgacctcactaatccaagtaagtatcgtgaatttctgactaaccatgcagacctgtttgctttttcccattcagatatgcaaggaatcccacgagacatcgccactcacaagttgaacgtcgatccactacacccgcctgtacggcaaatgaggagaaaattcaacactattatcaacaaagcggtcagtgaggaagtagacaagctactggccaacggttccatcagggaatcataatacccccaatgggtcgccaacgttgtcatggtaaataagaaaaatgggaagtggagaatgtgcgtagacttcaccgacctgaacaaggcatgcccaaaggattcattcccactgccccacatcgaccaactaatcgatgccaccgtaggacatgaactgctaagcttcctagatgcttactccggctacaagaagatcatgatggtcgaggaggaccaggagaaaacaacttttatcatccaccaagggacatattgctacaaggtaatgctcttcgggctcaaaaatgcaggagctacgtaccagagactggtcacgaagatgttcaaagaacaactcggtaagaccatggaagtctatatcgacgacatgctagtaaaatcagcaaataaagaagaccacattgaccacctaagggaagccttcgagatattgagaaggtacgggatgaagctaaaccccgagaaatgcgcctttggcgtggcctcgggaaaattcttagggtttctcatatcacaacgaggcattgaggtcaacccagactagatcaaggcgatagacgcgatacctgaagtgttaaatagcaaaaaacaggtgcagaagctgacagggcggatagccgctctatccagattcatctcacggtcctccgacaggtgtcataaatttttcaatgtactaaagaaagaccaagggttacagtggaacgaggagtgcgtcgaagccttgagaaagctgaaagcgtacctatcctcaccacccatactggtcaaagaaagcccaggcaaacccctgctggtgtatctggccgtatccgaggttgccgttagcgcagtcctggtccgtgaaaacaaaggtacgcaatctcctatttattacattagcaaaaccttagtggacaccgaaacacggtatccacacctcgagagattggctctggcactggtcgtagcttcacgaaagctccgaccctactttcaatgccaccccataaaagtggtgatgaccttcccgttgagaagagtcttacacaagcctgaattatcaggccggctcgccagatgggccattgagctcagcgagcacgacatctcgtaccacccgagaaccgccatcaagtcgcaagttctggccgattttatagccgactttactgcagaaatcctgccaaaggcggaacttgaggcacaacgtgcctcctccaacaccgacctatggattctctatagtgacgacgccgccaatgtatcgggatcgggacttggactcgtccttaaggttcccacgggcgaaacaattcgccagtccatacgataccccgaaatgactaacaacgaggccgagtacgaggtcgttattacaggtatgaaactagccatcaagtatagggctcgataaattatcctccattgcgactcctaacttgtgctgaaccaagtcactgggactcctaacggtgtttctccagtcagagatccacagattaatggctgagttcgacgaatgccgattcgaacaaatctcgagggcacggaacgttgaagcgaacgtcttagcaaaactagtcgcggccactaaaaacatcgacaaagaaagcgtggtcaccctcctccactcagccctcgatcacacagaggtattttctctaaatttgacttgggactggcgcaaccaatttgtatcctatctgcaggatggaacactgccactcgacaaaaaaagaggcaaagaagctctgcgtgcaagccgcccggtattgcctgataaacaatgacctctacaaaagaacgtttggcggacccctggccaagtgcctagggccgcaccaaatgagtccagtactcgaagaagtacacgagggccactgcggtgcccacataggcaaccgcgccctcgtacgatgtattatacgggccggctattattggcccaccatgaagaaagaggcagcagaatacgttcgccgatgcgaacagtgccaaaaatacgcccccatgatacatcaaccaggagaacccctccactcagtcacctccccgtggcccttcatcaaatggggaatagacatagtcggccccctacccgcgggatgaggaaaggtacgatttctactagttttaactgactatttctctaagtgggtggaagcaggtgcgtacgcacaaatacgcgaacaggaagtcatcgctttcatatggaaaaatattatatgccgtttcggcatccccaagtaaatcggttgtgataacggacgacagttcatcggccaaaaaacgactgaattcttcgagaaatggcatatcaagcgaatactctccatgccatatcaccccgccgctaacggccaggcagaatcttccaacaaaataatactaaacataccgaaaaagaaactcgaagaagccaaagggctatggcccgagctgctacctgaagtattgtgggcacaccgaaccacacccaaatctagcacaggagaaacaccgtactcactggtctacggaactgacgcggtcataccgatcgaggtcggtgagtcaagcctgagatattcacacaccaatggaacagaaaatgacataaacagactccaagacctcgatgaagccgaggaaagaagagaaatggcccacataagaatggtagctcaaaaacaacaagtcgaaagatactacaacaagagagccaaaataagaccactcaaagtgggagactacgtcctcaaagccaagacattggcatccaaagacccaagcgaaggaaaattgggcaccaactgggacggaccctacaaaatcacagcagcagccagtaaaggagcattccagttggaaacaatggaaggaaaaatgctccaaaacaattggaacgtcgcccacctcaaatatttccatttctaaaaggcgtctcccgagtcgtactcttttttcccttacccaagttttgtccgaattgggttttctcggggaggtttttaacctcatataaagggctacagccatctccagttgtgtaaagggctacggccatctccaatgtataaagagctacggccatctccaatgcataaagggctacggccagcttcaatccaagtctggctaaggctatcaactttattatggccaaggccatcgccgccaatagtcgacctagtttgactacggcaagcaagtgattcgacgacagtcgaagtcacctatctggccaaggccatcaacttcatcatggctaaagccatcgacttcattatggccaaggccatcaccgccaatagtcgacctagttcgactacggcaagcaagtgattcgacgacagtcgaagtcacctatctggccaaggccatcaacttcatcatggctaaagccatcgacttcattatggccaaggccatcgccgccaatagtcgacctagttcgactacggcaagcaagtgattcgacgacagtcgaagtcacctatctggccaaggccatcaacttcatcatggctaaagccatcggcttcactatggccaaggccatcgccgctaatagtcgacctagttcgactacggcaagaaagtgattcaacgacagtcgaagtcacctatctggccaaggccatctacttcatcatggctaaagccatcgacttcactatggccaaggccatcgcctccaatagtcaacctagttcgactacggcaagcaagtgattcgatgacagtcgaagtcacctatctggtcaaggccatcgactttattatggccaaggccatcgccgctaatagtcgacctagttcgactatggcaagcaagtgattcgataatagtcgaagtcacctatttggccaaggccatcgactttattatggccaaggacatcgccgccaatagtcgacctagttcgattacggtaattaagtaagtcgatgatagtcaaaatcgcccatacggccaaggccactaacacgatatgactaaggtcatcatcttaattctggccaaagccattgtcacaaagtgccgacctagctcaaccacagcggaaagcacgaaggcaacaatcagaaacacaataaaagttctaaggagcaaagaaaaagaatagcagcagcaaagagtcatatttcactatctccaaaaatacatgtacattcgaccttagaaaaggtcccatttacatccaaaaatatatatacacatgaatcctaacagccttcgccgcttcgtttatcacgccctgcctgatcaccattcggtccgttaccatctccgggcaggtaagtcttagaaatccaggaactggattccaagcggttgacgtctccagaattacaaccctccctatctggtgaatcagagctgtaatcggccacctcacgggcgacgcgagttaggcgccgctgctcctcaacttcagcctcagtggcccgatcggttgaaaaatactcctcgagtacgacaatctatcatcgtggtatacccacatctcgtgcgcctcacgatgcgcatcaccctgtggagcggttcgcctaaggatttcaatctcggccgtcttagcatcaagcttggcagtcaaggctgcaaccctggtcagcaattgggcagcctctaccgctactccacggctaatttccaattcatcttccttcgactgaagaagagtctccaactcggcattccgtgctatagcggccatcagctgctcatcaactttctccagctcagacaccctcattttcagctcttcctctgattgtttgaggccctcacgaaacaccctaaatttagggttctgcttgaacacgtccgccaatgtctggtgcgcatcacggtaccgtttgtacctcttcaccatcttattaaaggcggtcgctttctgctgtgcacgtcgcctcctctccacctccaaaacaaggatctagaaagatagaaagaaaaaagtcagtacgcagctaagtcaccctcacaacgcaacaagaagaaccaaaagactacctgcaaggctatgccggcaaccctccgggataggtccctgctactaacactttccaacatctcactctcagcagccgcacacaagagggtcatatccgttgcggcttgctcgctgttctccaatagattatagccacccaaaataatgattcggcggttggtccagccagccgtcatcccacgcgagctgacgccctcaccatatcatctgcatctccaacggcggccttagggctcgccctctcggcatctacgtctgtttcttccacagcggccgacgaaccgccctcctgaacatgggctgggctggcttcggcaacaaccctcctttaaggaacagacctccccgaacggatggcatcatccatgaaagctggcctcgactcgtgacgaggtaaactaaccctctcatctctagacgttattcccttaccggtgatcagccgctttttctctctagcggctcttaatcctcagaggcctcctccacgggttgcgaggacggccctgaaggaaccatttcactaacagatgcggcctcagttcccctcacggtcatggcctcaagcactgcctccgacaccgccacaggcacctcctcggatgccgccaccgacacagcctcctgctgagaagttgtaggaacaccgtcactgggcgaaccgaggaatatatctttgccatcggagttgatctccaccctagacgggataacaacagtctttttttttttttttggaaacactccgacctgccggcgcaagtgtgtcagatatcaaaaacaaaaggaaccttcaagacaaagccaaaaattattattacctgatgggccgtacagtttacagaacatggcccaggtccggcactcctccgcgtacggtatcaatctctccacccacgacctaatatcgtcaatagttcggggcgagcgagccgccactacaaaaggaagacaaagaaaccacgatggttgagctgccaggacaaaaatcatcacaaaatcacacacaaggaaacttacattctgagttccacgtctccgggaacccttcggggttagacaccaggtgctccgtcctgatatagaaatatcttttccagaagccgcgattgtctttatcatcggactgcactacgaagctcttcgtaccacggcgcgtcaaatggagcatggtacccctcaggtagcttgcattgaacatctgcaaaacatggtgaaccgaaaccacgctcccgaccttggccgtgtacgtggtaagaattctgcacaccttcaaagtataaggcgtgagctgagccgggcacgccctgaataagcggcagagatcctccgctagagggttaaatgggaagctgtatccaattctaagcggatactcataaaatgtgcagaacccaggcctatgcacgttggcatagtccatcccagccggagccatctccacatggtccggaatgttgtacgtcgcttgaagggcatctaagtgggattgaagcaattcactgagctcccaaggaagaggtgagctctttttgttaaaatcgtttcggacattcatactctttggaagtatattgtccaccgatagagaaacaagggctttttccacttcttcctcttcaccaccggaggaaggcagaaccctagaaggagcattgtccttggcctttttgctattttgatgacgcttcgccatgatttgctttacgaagataggtgttagcaatgaagaggtatgaccctaaaaaatggaagttttcaaatgaagcaacggttgccggaaaaaaagacaaagaaagaaatcaagaaatactttctaagggttcgaaagatgaatcagattgaaccgctcctctatttataggggtaagatacgcggaaatcgaaaaggcatgattcgaaaactggcgcgggaaaccaaaacgtcacatcacgttctagatcacctcgggaacaagtgtaatgatgaagcacgtgatcggtgatgtcattctgaaaagaggccatatgtcaacggctcacccatgttatgcatgtttgcatcattcgagaagacgcccaaggacgcggccaaattcccttaaggcgaagcttgcagttccgtccattgaagacccccatcgagcacgtctccaacgaacggagggactaactgtatagggtcaaatttggccctcaacatccccatgctaatgggcatgccccaacaagcagacgtcgaccatagcgagggtacggcccgggcggaggagtaaaagcgacgtcgtttagaacttagcttcttcgttaagtagaggttatctgcttttgtacttttttttattattttgaggaaggtctcctactatataaaggagaccttcacattataacaggcatcaagtattattatcaataatacaactctcagcttctctctctatctcaaaactctctctctgaaaccattattatctcgttgtattatcagatctacttttacattatcatcatctctaactctagggcatattatatttgattacgatttacccttatcttctttcgattatttttaagcttacaaagtatattgacaacttttgagccaaacagttagtatcctcagtaatctccgatgatatagctcgaactatgtataccaagtgagaaaatgcttttatcgttgttatacgtatacacatcatgagtattagtctaatatattagttgtgctatgaattatgttttattcttgagtaacatggcaataacatgataaaaaaattgtctgcaaaattgaagtaaaagctgataaacttagagattcacagcaataagaaaactggttttcattaataactggaaattacagggaaagaaaacgaacaatagaacactaaatagaaggggatgagacactagaagaaagggatgagatatcagaagaatttggggtgagaagggtacatagtattcataacgttcagcatagctaatacgtccaagactctgccaattatataaccaccagattccttgtaccccactccactaattaacccctatcctctaaccatggttcacaacatagtcaccaagtctgcaatttggctttttgatcctttgacctcttcctctattatccacatcagctccttggtccaccaagtcttcccaattactagccaaacctttctcattcataacattacctccctctgaatttaaaaccttgccctcaaggtttgtatcagctgcagtttccggtttttgaggaaacaagggaatgacctgttgatcaggttgtcctacacacctcttgagcagcgatatgtggaaaacgggatggatgcgagcagaatctggcaagtccaatttataagccacattttcgatccttttaatgaccttaaagggtccaacatactttctgcccaatttatgatagcgttggagtctcatggagacctggcggtacggtttgagcttgacatatacccagtcaccttcctcaaactgtgcatcagtgcatttcttatccgccactaacttcattcgatgttgagccttaagcaaattggtcttcaaattatccagcatttcatctcgtttaagcatatacttctccaccaaatcatcagaggagctgcccaagatataacgaagcagattgggtggctctctaccatataaggcctgaaatggagtcattcctgctgaatttgatatgctgtgttataccaaaactcagcccaaggcagtacttgaacccaatcatggggactatcggcaacaaaacaacgaaggtattgctcaatgcacttgttaagggattcggattgaccatccgtttgtgggtggtaggcggtactcatggccaaagtagttccttgaaggcgattgatctctttccaaaaggattgaaagaacctagaatctcgatcactgactatgacccggggtggtccatggagcctgataatgtcgccgacaaacacactagcaacagagattgctgaaaatgaagatggaagagcaatgaagtggccatacttagaaagtcgatccacaacagtcattatagttgatttacccttcgaactagggagacaagtaatgaaatccatagctatctcctcaaaaaccatggaaggaatcagtaatggttgaagcagtccagccgggtatttgaaaatatccttcatttgttggcacacttgacaagctgcaatgtgtgtactcacatccttcctcatgtgcttccaataaaaattagaagatagacggtggaaagttctggctaccccgacatgtccccctactggtgaattgtgaaattcttgcaataggtactgcttaaggaaggaatcagaaggaagaaccaatctacctcgaaaaaaaaaaatcctttcctgaaggaaaaatctggatatgctgtaggatcactgtcaaggccactttgaatggcaagtagctcaggatgctctttattttccaagcgtaattcatccacgaaatcgaaagttctggttgacatggccatcattgaggcttcaggaggtcgagataatgcatctgcagccttgttacttcttcctggcttatatacaatgtcaaaatcataacccaccaacttggtcaaccatttttgctgttccggagtttgaatgacttggtctctgagattgcgcaacgactgctgatccgtaaagatagtaaattgtcttcccaataaatattgcctccatttagagactgcttgcgtgattgcaaacatctctcgatgataagtggaagcctgttgcatttttggacaaagcttctggttgtaatacgcaattgggtgaccattttgagataatacagcgcctatggctagtcctgaagcatctgtctctaagctgaactcttctttgaaattaggtagggccaatactggagtggaacttaaacgaccttttaaatcctcaaaggctgattgggtttgggtagtccaaacaaatgagtccttccgcaggagatctgttagtgggctggttaaggccgcataatgcttaatgaagcggcgatagtaccctgcgaggcccaaaaagcttctaacatccttaacggacttgggcgtgggccaagattgtatcacctgaattttggatggatccacagccagccctgcaccagaaattatgtgacccaagtattccacctgagtttgcccaaacaagcattttgatcttttggccactaggtgatttgagcgaagcagatgcagaacttgctccaaatgtagtagatgggactcccaagaggtgctatagaccaagatgtcgtcgaagaaaactagaacaaaacgacgcaagtgtggtctgaatatctcattcattgtagcttggaatgtcgacggagcatttgacaacccaaatggcatgactaagaactcgtagtgcccatcgtgggtacgaaaagccgtttttgccacatcttctggcttaactcgtatctgatgataccctgataataaatccagtttggaaaagaatttggctccgtgcagctcatcgaacaattcatcaatagagggaataggaaactgatcccggactgtgatcgcatttaaagctctataatcaacacaaaatcgccaagtaccatccttctttcgcactagcaacactggagaagagaacgggctaatactttggcgaattataccctcagacagcatatcggacaccagttgttccatgacttgtttttgaaaataggggtatcgataaggcttcacattaactgggccggcatttggaattaatggaattgaatgatcttgctggcgaggcggaggcaacccttgtggttttttaaatacatcagcaaagttgacaagaatgttagacaaatccgggggatgatctaaatcagaggtgattccctcttgaaccatcatcaggcaaaaataagatgctgctgcctcagtcgcggaataacgacgcaaggtctgcaatttcacttgttgcacatccaagggagggtctgctatccaacgaacccctttttccttaagtgtgaattcaaaaactcgactagcataatctgtcattacaggccccaaagaggctagccacgacacacccaagacaatgtccgccccatgcatgggtaggacatacaaatccagaataagttcagagccctggactgtaagggttacttgaggcactagcccttcacaaattaggctttgcccactacccacaacaacagggaaacgaggaatagcagtaatagtgaaattgagaaactttgcggccctggtttgcacagaattgtgtgtactgcctccatccaccaacacctgaaccggtgagccattcacatggcccttaaatcgaagagtggaaccagaatgccctcctgccaaggcatgataggaaatagcagaatggtcctgaagttccaagtttgtgaactcctctgaaggaatctcatcggaggcaatagggtctggaaaacaaagttggggttctggctcattatcaaaaagaaggagttgaggtaggtttttacacttgtggtttggagtgtatttttcgtcgcaatggtagcataaacccttttcacggcgttgtcggagctcgatgggtgaaagacgtttaaaaggaattttgccagaagcggcagtgttgacactaggggcaggccgtgtttgagtgagttgaagtttagaaggggttggaaggagaggttgcgtattacccaggatcggtctattgggccctcactccaactcaatgcgttgttcgtggagatgggctaaactcattgcctcctccaatgttttgggctgttggattaacaaattagtctgaatatccgaattaaggcccgaagtgaagaagtgaaccaaccatgagtctgatatctcctctgtttcgttagacaaagcctcaaaatgtgagcggaactctgccactgacgaggtctggtgaagcttagaaagacgaccttcaggtgactgcagggtcttttgccggaaacggcgaatcagcttctcagagaaatcatcccaacctaccaactgcttgttacagtgcatccaccggtaccaagctcgagcttctccgtcaagataaaaggatgtgatgttcaaacgatgctccgtgaggatagaatagaaatcgaaatacctggtcgcatcaaaaatccagtcatctgggttatcaccactaaaacggtagagctcaacagcagcaggtttgtgtcgtagagacactgggccacttgttccatatccttgagaaatgacaacctccgacgggtgccgtggcgaaggctcacccacagaatcatgcatacgagcaccaatattggacatttgtgagaggatctcctgcatcagcttgttttgattatccatagcagttttgatatcagatacctcacgggctaatccgttttggccatcctccaagaccttaagacgtgtgtccaccattggaacgtcaatgaaagcaccaatgaagtaaaagctgataaacttagagattcacagcaataagaaaactggttttcattaataactggaaattacagggaaagaaaactaacaatagaacactaaatagaaggggatgagacactagaagaaagggatgagatatcagaagaatttggggtgagaagggtacagagtattcataacgttcagcatagctaatacgtccaagactctgccaattatataaccaccagattccttgtaccccactccactaattaacccctatcctctaaccatggttcacaacatagtcaccaagtctgcaatttggctttttaatcctttgacctcttcctctattatccacatcagctccttggtccaccaagtcttcccaattactagccaaacctttctcattcataacaaaaatatttacttaaattatattaacttatcatgattaagtaatttaataatgtatgaaacattactctttaataacgaaattattttacccaatattggtaacccaacgtgccctaagactcctattatagaaacacaaaaagaaaaaagcttcttttgtatttatcttttcaggaaaaacaaaagtgatgaaaactgaatcaatgtttaactatcttctcatttctttttccagtttcggtatcgctcgtatttttaagacttttcttgagttataaagcaaatgaagagagttgtccgtaccgataaggattgtaatggagttataaatatttattcgtctttaagtgttaagtttgagttcagaatatgaattcgcctttgttggaaagtggcaaaccgcttttacccgtcaaagtaaaattgtcaatgtgtatctaaatttaattgagcccaaatatacaaccgaacactgagtgagaaataatctatatctatctatactatattaaaagcacgaaggcccttagtgaaatgtcgttcgcctttttatccttttaaaatagagttcacactagacaaaatagtcatttaattattcttctaactaatttttaagtgtttgaatccaatcaaatttattattttaatatatttccttatttgaattaagtaagaagtccttatatttaggactttaaataattaaagttttacctagattgtttcaaaggcaataccttaattaggactttaaataattaaagttttacctagattgtttcaaaagcaataccttaatttactgtagtgcatatttccgtcaactagatgaaaatgacttttttggttaaaaaatgtttattacagaatttgactttaagaaataagaattagctttgaatttgacagctaataggatccatcacaaacatgtagctaaatactattcagcaatgaatatttgccttttagctacataatttatttgtcatattttttttatttctttagttgccctgtatagaatatacattacttagacaattattttcatcctaagttaaaatgaaataagaataaataataaattactaagctatcaaaattattttttgctgactaaatagaataaatattcgtcattttcaagagcttatatttttaaaattttattttataattcaaacatattatttaataatattaatataatttataaagtttatactcattgatatagggtacacgcgcaaagcgcgtaccgtaagactagtactatattaaaagcacgaaggcccttagtgaaatatcgttcgccttttttaccctttaaaataaattttgcattggataaaattgtagtttatgttattttcctaaaattttaggcattagttatttcctatatttaggacttaagattttgcttatattctttccttatttgaatacaatttaacactctaaaaagacaacggactaattattacttgggattattacttactaatttggactcttgtagcaaagttattggattgctaaattgagttttagctattacttagaattattttaagttttatttatttattttaacgatacctaaatttttttgttagaagacctaatatttaggactacttctttttccttacctacataaactgtactttttcaagcatcacaaaaggtgatatgatatttaaacaatgaagttttcacaaatcttagatagactaatatttaaaattttgaagttaattttgaattttcactttacgttttcaaaaacttaaccctatacaatcgaaattttattaattgtagaaagaagttctttgttaattcattgtgttaaaaataaactcatctcaaaacaaatagaattttttttgataatatataattagcgacagatttttaatatttagctgcaaatttggtttatcgctaattttttttatagttgacctgtattctatactcaacttcattttgtacgacgttcagagctttcaaaattatctggattgtgtcatgcttagcaacatcattcgctactttgctgtctaatatttgacaatttaaaaaaatattaaacatttattatataactcaaataaattattttatactcccttcgtttcaattcaaatgacacatttttcttattagtctattccaaaaagaatgtcacatttctatatttagaaacaattcaactttgaacttttttattttacctactttactcttattgagaaacttttatagccacacaaatattatggcccacaaagcttttgtcccttaaacttttagaacctatacttcaaaagtctttctttttttttttcttctttaaacattgtgctaagtcaaactatatcatctaaattaaaaagagagagtaatatttataaatttttcaaattttacattcattgaatagggtggcccttagcaaaatacctatttccttttttacctttaaaagatggatctatgtgtttattttaatggagaataaaataagctaatgtgtcctcttctgtctttgttctttctccaaatttttgtgtagaaaaaatgtgatctactttttcttgcgtcttacaccttcatgtaacaaatatatataggaataaccagtattcaactttagagagtttggttaaaggtatcattgatgatagaaaaatttatgttctcatattcttgtccttctcattttgtattgtggtgattgagaagttctatggcagagtttttccccccattatattaagttacctaaatacaatcaacgatcaacaatcatcattttcgaaaacttacacgaagttctttaaagttttattctataatatatttttatataatttttagaatttttatactcattgagatggggtacacgtgcaacgcgcgtatcttaaaactagttaaaaaaaaaggggggagggggttgtcctcttgtttgacttgaaacatataaagagtcattgggtacgtcatttaagtctttgggtattgaacaagtcagaagagtatatatacaccactatttctagatattttaggataaggtaataagttgagcaaacttaaaaattctttattgcatgattatccactaatatatcaatatttaattttaatgtactatgatattatctcccccaataagttctgtcggtcatggcggaatgacgggtaagtattcaagggaaacttacagaaatgtcccatataagttttaacttaccaacctctagccaatatttcaaaaatcgaaacaaacaaggaattttttaatgggtatagtcaaaattcatcgaaaacatatagataagtcaatatacaaaatttgatgaagattggaggtgatttggactggttttgtatcaaaattcataattaaatcgatgtcaaaaaattcttctgtgacacatgtatcaaacatgtatcacgcatgtatctcacgcacagatatacatgtgatacacaatcgatacaaatatgatacatatgtgatacacagtgtgatacacgtatcattttttttcatattcagtttttacttcgaattttcaattcaaaccacgtcaaaacttcaccaaatcatcccaaaactgagattcatgctccttaagatatacccaatctattctaatagcacctactcaaaagaaagtaaaaatttgatatttttttgctacaaatagctaattggccattttggctaatattagtaatattttatcaattggccaatttttgtaatgggctacttctaaatggacatagctggtaatttccctagaattaaccccaaaaacaaattgaaactcattttcagaaaatggaaaacctgggtcgtcagctctgacgacttagtgccctaaaaagctcactgaaaatttcctccgttcaacttcatctcacttcttcttgtttcgatttcactgaaatatcacgttattccctctattcctcgtttaagagggtgtttggattggcttaaaagattatcaaaccagcttaaaagcatttttggacttatttgagtgtttgtatatgctataaaagtgcttttaagctacatacttttaagctaaaatacccaaaacaagccaaaagcaataagttggacaaccctaacttattgctttttggcttataagctccttatgtttgaccaaatgatttaccttactatcccttttactttttctaaaccctaaaactacccttcccttactaattaaagtgtcagttctcatcaccattttccagtttatcgttgctgctatgttcaccaaaattagttaacttttttgaagtgctaaaagggaagccaacagtagctttttaaatgaatgtttgatatattctaatattttataaatattattctttagcttctttttttggtttcatcacaattactggttgaatccgtcctttgtttaattgctgaaactatattctaaatcaaatatttcaatgaatttacatgttacaccagaatctgaaactatgaatggaaaaatcatgtttttggtcaaataattaattattgtatattattaaagaaataatttatatttaagtaattaattgaaattgaaagtgatttaattataaattatttgtatatgcattaatttagaataaattaacatctgttatgaataatttgtacattggatactacattggatgctatattggatgcccatgttgtacattggatactacattggatgctacattggatgctacattggatgcccatgttgtgaatatcttaaagattaaatctcctattttatgtctatcatctttactttttatgcctataaaaggccatgtaattacaatgaaaatatacacacaatggaagaagaaaatctcttccttctctctatctccatttcttgttcatgttttactaaattgcttttatttccttgttccatattgttactttgagttatattttataacacgttatcagcacgaagctctaatttttaatttcagctatcatcttattatagtacgaagataaccaagttcatcgttggactacaaaatattgaacacaaagaatcaattacgttctcggtgaaagtttgagtatttgatatgtgaatcaatttacttcaattgtccagggagtattttttttatttttcttgtgatgacccaaagggtcatcatttgctttattagccatttcgagctttagaggccttgaaaacctccttataggttgcctcgatttgcgtgcgcagttcgggcgcgaagccggaaaatttatatgttgaaatacttgaattatgtgtttaaaatgatgaatttcaagtataatattgatatagttgactttggtcaacatttttggtaaacgggcccggacccgtgatttgaaaatttctgtagaaccgtcataaaatttgggactcgtgcatatgttcggaaataaattccgaggtcccaagcccaagatatgggaatttttgtaagactaacttttgaaattttcttaagtatttgaaaatgattaattgatggttgaatgtcgtatcgggctcgtattttggttccgacgcccggtacaggtcatatatgtggtttaagcgatatctgtaaagtgtggtcgaaatcggacgtcgtttgacgtatttcggacccgaaaggctaaattgagagtttgaagataaagttgggaaaacatggattttcatggttaaatccgttgttttgatgttataatggcgatttgatcgcacgagcgagtttgtatgatgtttttgagtcagtgtacatgtttggtttggagccccgagggctcgggagtgttttcgggggtggttcggagtttttgaatttcaaaatctggtgtctgctgtttctttcgcatttgcgaagatttcttcgcaaatgccaagcctgccctgcctttcatcgcatttgcgagatagtcttcgaaaatgcgaagacccagtttccctctccagcctcgcaattgcgagcctttggtcgcatttgcgacccagccccttttccttgcccgttcgcaaatgcgaacatttcatcgcatttgcgatgcctgccgtgtcccagcctccttcgcaaatgcgaagtgtttctcgcatttgcgagaacccctgtttccttcttcacttcgcaaatgcgaagtatttatcgcatttgcgacatctgaggccctgttaaatctgacttagccgaaaataacaattcatttccaaacttttcaacaccaaaaacgtaagaggcgatttttcactcaacccatcttcatcaaatcgtttgtaagtccgtttttactcaatttcttcaattattatcatcatctaacatgatttcttcttaaatcaaagcttttcatgggtcaaaaatggagattttcataaaagttagggttttcacatgtttaacttttggacctcgatttgaggtcgaatttttgaacaaattgcatattcttactcatgagtgattgggttgtcggaaattggttcgaccctcgagttttggccacgtgggcccggggtcatttttcactattcatggcaaaatagtatgcatttcgtttttggcattttagaacatgttattgagtagatattgatgatattaaatcaattatgtatagatataattgatttggaggcgaattcaaaaggaaaaggcattgcttaaggcttgaatttgctaagtttcgaccttcgaagtaagtgtttgatctatcctagcttgagggaataggagttgagtctatttgctaattgctatgtgtggagtccgacgtatgggcatggtgacgagtatccatatgttgggggtctagcatgatcgtgagtcattattcttgattatttgatattgatataatttccacacttaattgttaaattattaataacgtgataagtgtgagaaggaaattatgaattgtaaatttcctagagcgttggctcgaataatgacttggtaatttgagtaagaaagaataaaaggtatgagatgatgaccttcactcattattattgaattctatgaagaattaaattgtggattgtaatcccttatttgaatcttatgcacttgttgcatttattatttatacggataacgtttgggctgaatgtcacgtttgggccatgggccgacttgatatgtccttaaaggactgaggcgagcgaactagcatgatatgctcgctatacattcattatgcattatttgcattcatatggatcgggctacacgtaccgtagcaatggaatattatattcataaggatcgggctgcacgtaccgtagcaatgaatattgatatattcataaggatcgggctgcacggaccgtagtaataatatatttatatgggtcgggctacacgtaccgtagcaatgaaataattattaaataatcggagggtcgggttgcacgccgcaacagagaatgaaccaagtattgaaagggtgtatgtaaagttgttcagtgatatttctgtacctgttgagctgtatagtattcacttccctaataaatgattatttatttaaagtgatgctagttcagagcatgttttcctctttcccaaataattattactgttatctgctattttgttgcacatatatattttgaactgtacaggtttatgtgagtgtctggtcctagccttgtcacttacttcgccgggataggccgggcacttaccagcacatggggtcggttgtgctgatactacactctgtgctcttttgcacagatacaggtcttggacagcagcagcagcatcagtagtagcacaagagtgtcttttgaatatctggaaataccgaggtagtcttgcaggcgtccgcaggacccggtcttccttctattttattttcagtctgttatctcatgtattcgagacaaacagtacattatttcttccagaccattatgtgtattattcttagaagttcgtgagtattgtgacaccagtttctgggtagtatctcatgttgggatttaagtatcgaagttagtaaggtttgttaaagtcttccgctaatttattcactgttattcgttcatttattattaattgttttaaaatcagtattattaaaaatggttaataagtagagttggcttgcctagctcctactagtaggcgccatcacgactcccgatggtgggaaaatcgggtcgtgacaggcctattccgccgacgaatcctgaactacatatggcctgattcctataagaccaaaaatatgtaggcatctcaggaaccaaagcacggtaaaattcttcaaaccattttgttcggtccaattggccatcatatctttacccgacaactctttcatccttcccgggtaaagaggggcagttgttgatatccaattttttcctgtataatttttatatgcaaaatattttcaaatagtatatgtatgcatatataagtgtgtccaaatattttagtatttttcctaattcttgaaggatttttaaatcaatttattgccctattttagcagtacaaaaactaataattattcccaaaattatcatttttggtgattaatttattttattctcatatttataccaaaatatagctaaggtaatgtttgtacatttttacaaatttatttattattttttaaatcttaattgcacataattgcaattttagcctattttaagatttaattgcatttataattacaaaactaattccagtatttttaattccatatttatatattattaattaatttagtatcttaatttgttttcaaaaatcattttaccattttttataaaataaaaaaaagggaaaaaatggctatttaaatactagccctattttatttcaattatagcctaaaatcagccccccaattaacccaatttcaatttcaaattgcccagcccaatttcaatttaaaccgcccctgacccatttaatccaacccgcccggctccccaataaatctaggccgttgatcaaaataatcaacggccacgatccctcctttccttttttaatccactaacaccccttaaccctaaatcatttcacctaaccagctgcctctgaaacaccccccctctctctcaaacactctcgaaccttccctaaccctagccgcctctcatcatcttctaccttgaaacccaccggaatccatggcctctcaagctatgggagtcttatacccacctcctcttgctcccacgcacctgatctatgaagattcgaggcctgacctcgagggttttcaccaagacctatgccgattcaaggttccacggccctctccggccttgctccggcgtaccatagtcgtctgagcctgattctgacctctccgactcagatcggtgacctttcaaagcctttttcatttctagggctcttctgaaaccctaacccttcgaggttttctccgattttctttagatctgttatgtatctatgccttccctgaatttttaaacgatttccctaacttcctttcaaaaattacttttcaaagtctttcttttacgatctagggttttctgaaaaatgtttaagtgtttctctgactttctttccttttctcttgtgtgtatttgcctctactattttcttatgttttccttctatcacgtatgttcttctactgtgctttctatattccgttcttgtatgttcttctactgtgttttctacactatgttcttgtatgattttctactatgttctgctattttcttctaccatgctctggtatgtttcgcctgctgtagttttctaccgtgttcctaagtgttcttactatttttcttctactgaaccttgtttgagttcttctaaaagagcctcttaagcatgtttcctctactgttcttatcagtatttgccattatgtcctttgaatccttctactatgttttcatgttactttgatatcacgttttctcaatgagttctgttgctgaaagaagcatattaggagtttcagttcttttctgaaacctctttcaatttaattgcttgcctcctcatctctgtacttgattcaaggtggaaaccttagaatttgggggttctgccgaggtttgattatgtgatttgattgaactagggttttattttagaacccttaactctttcaaactgactttgagtctctgaactgagtttggacatctttgtttttcatacaatgctgaactttttgctaaactcttctacattggatttttttctactgatttacacgacagtcttctttcatgctcacatgctccttatatatgatgaatttccctctaaatggttttcaaatttgcaaatagtgcaaacttccttctgaatatagcttgattgatttctttccatcgtttactgatttcctctgtgactcgacttaagtaaaacccttcttcatcttttttgacttggttcattcataccaaatctcagaccttatgattttctggctgttaattgattcccttaccttatttgcacaaaccgtgtattgtcaaaaccttgtccttaaataacttttatgtattcacccctaattgcctactttgcacaaagtgtttgattaatttctttccttaattggtttatacccatttgaatctgaatcccttaattaagggaagccctatgtaattgattgacaattagttttcaaactattttattaccttatttctgcctgctttctacactataaaaggcacgaccctttttcacaaacgattttacaattcagaacttcttctacactcatactcacttacatataatagtattcttgcttcttgtctgcactgtggctttcacaagactactgctttctttttacttgtttctttgaaattggtatgtcctaatttaagcttcagcatctccacaatgtgtttacttacagctttctgtatccaagtctactttctactactgcagagttaaatatttaacttgcatgttaatttctttttgcttgtttctgctatgaatccccgctccctattttcctttatgtgctttgagttacagtttaaaacatggcaatatgcaagttattgtctatggtttgaacttgatcccttagaggatcctaacctctaaaacaatgtgtcttaaacagacctaagggtgtgccagcatctcccattgttggttaggcctactagtctgccttttgcctcttgcaactctccattccctatacccctatgtgtgaactgtttccctttccccttttcagaactctgcacttacactctctcctagtctctaagttctgcccccctcttgtgagccttggcttgggaccttgagttccctctgaacttggacacttgagggatgacccttccacactgcactatgtcctaatctggtaacacatttgggtgtgagcactgcccggagtccatatgaggctcttagggaactctgacacatccaaatgagagaaaggctttggatcatgatctcttggaattggttcatctcatatttcagacatggagtctgaattaggctccccttggttgtacttttaatttctgatgtatttttcctttcttacatttattctgggatgtaataacttgtaataaactattggggatgactagtgaaaaagggagggtaatcatgcatgcaaagggtagatatcctgcctataggtttctgaaattctgcatccatatagatatcctgtctataagtttccgaaattatgcattcatatagacatcctgcctataggaattctgcactttcacatatagacatcatgactataagaatttctgcaccttcatttagataacacgtctataggaatttctacactcatatatagataccatgtctataggatgcacatgcatgtagaaatatgactataggtcatttctgattcttacatactcatctctcattaggcaaacatgtttataggccttagtaaccaatgtaatcagatatcacgttcgtaaccaaaatgcaacacctagataatatgttgttggatttctgcatttctttatgtccataacagtgtttaaagttgacaaacacatagaaagcatgcctataggggttctaatcaaatctgaatcacctcactcgtttataagtttaaaactataagtagtaatgcattatcaaccgcaaaacttgtactcttctactaaactggcaactttttcctaaattaatctgtaatcagtttacctctttgtttctaaaatcagtagatatcatgcctataggttttcgtctaacacttaggcaatccttaaggtaaaagttataaatgcaccagtctttattaattacaaccagcggacatgcctaattcgaacttcttatatgaaaatatgtgataaatcagcctgctttaacttttaagttttaatcagaccttaatcagtacgtgcaagacatgctaaactatatgcttttctttgatttaaggaggtctgtttgagccttatttgtttatgtgctttccccaaacttgctatatatgtgttttgatttgtcaccttagaattttggcctttaaaactataaaagcccaacatctcttccctttaggattagtagtcccaaatgcctccgggactgataggattagggcgggtaataacatgcaataagtaaacgagaccactccgcgctttaataccttaacggggtggaaaagggtagatatggatatgatgaccacgcgataacatctcgtgtagcccctcattgaggagtgattaccggatgttgtatggggtgattcatattatttataaacctaggacccccttttactttatttgtttatcttattgtttactttcaaaatttcaacctattttcttgaaattcagcttttcttttgtttctttaacttcatctatttgcaaccattatgtgaaaatcccctcttatttgaaagtcttacttgcctacatgtttttgcacttaaagtcacaattatagtatggccggaaaccatgctagtggatcctgaggggtgcctaacaccttccccttgggataattttaagcccttacccaatctctggtttcctaaatcaaactcttcttagtgtcctaatgcaatttaatcattaggtggcgactcttctattcaaacccaattcccaaaagggaacgagttgtcctcccaaatgtcataaacccgatttcatgagaaaaagggggcgcgacaacatcccatactagtaagcagtggagatcactcggagattggatggtatatgggtctgggagagagaggatagggtggctaagaggcctcaagattctggcacatatagtggtgctcgtgccccagttacagcctgtcatggtagaggctaagtgagccatcctgttcattcagcttttccagcttcatgcggcatttcggctactttcaggcctcaggctgcccattatgcaccgccactgtctagtgcacctcctacatgaagttctttcagcaattagtccagccgaccaggctcgagccaattgcagtagccatgtcctctgagagtttgttttgagtatgtaagacttgtcatatagtaagggattgccccagactcaggaagggtacatctccacagactactcaagctctgcgtattccatagggtcctcgggcttttcaggctatagatatcgcaccagtttccactccacctgcacatccagccaggggtggaggtcgggcaggtaaaggtcgccctagagggggaagccaagccagatgttatgctcttcctactaggacagaggtggttgcatccgacttagttatcacaagtattgtttcggtttgtcatagagatgcatcaatcttatttgatccaggctccacttattcatatgtatcatcttactttgctctatatttgggtatatcccgtgatttcttaagttttcccgttacacgccagtgggagattctattattgttaaccatgtataccagttgtgtttagttgttattggtgattttgagaccagaaccgacctattattgctcagtatggtagattttgatgttatcttgggtatggactagttgtctccctatcatgttatccttgatttcacaccaagacggtgacgttggctatgccaggtttgtcacgattggggtggagaggtactttagattatgtttctagcagggtgatgtctttccttaaggcacatcagatggttggaaaggaatgtgatgcgcatctagcatatgtgagagatgtcagtattgatactcttaccgttgattcagttccggtagtaagggattatccagatatatttttgccagatcttccgagcatgccacccaatagggatatctattttggtattgattttttatcaatcactcagcccatttctatcctactatatcgtatggccccagtagagttgaaatagttaaaggagaagttgcaaaagttacttgataagggtttcatttggcctagtgtatcaccttggggtgctccggtcttgtttgtaaagaagaaggatggttcgatgtgcatgtgtatttattatcgacagttgaacaaggttacagtgaagagcaagtatctatttccacacattgatgacctatttgatcagctacagggtgccagagtgttctcaaagattgatttagggtcaaactatcatcagttgaagattcgggagttggatattccaaagacttccttcaggactcagtatggtcattacgagttccttatgatgtcatttgggctgaccaacgccctagcagcattcacgcacttgatgaagagtgtattaccgccctatcttgaatcattcttcattttgtttattgacgacatcttggtgtactcccggagccggaaggatcatgagcaacacttgaggatcgtgctccagaccttgagagaaaagaagttgtatgcaaaattttaaaagtgtgaattctggcttgattcgattgtgtttttgggtcacgtaatattgagtgtggggatcaaggtagatctgaagaatattgatgcagtgaagatttggcccatattgtttttagagttttctttgtttggcagggtattaccgtcgttacgtagatgttttctcatctactgctgtacctatgaccatattgacccaaaagggtactccgttcaggtggaccgtggagtgtgaggagagctttcaaaagctcaagactgctttgattacagccccaatgttggttttgcctacgggttctagatcttacactgtatactgtgatgcatcgcgtgttggcctcgacgcggtgttgatgcaagacggtatggtgattgcctacgcttctagatagctgaaggtgcatgagaataactatcatgcccatgaccttgagttagcagctattgttcatgccttgaagatttggcggcactatttgtacggtgtgccttgtgaggtttataccgaccaccagagccaataacatctgttcaaacagaagatcttaacttgcggtagtggagatggctagagttgcttaaggactatgatatcactattctatatcatcatgggaaggccaatgtggtggccaataccttgagtcaaaaggcggcggagagctttggcagtttagcatatctaccgatagcggaaatgccattagcattggatgttcaggccttggccaaccagtttgttagattggatgtttcggagtagagtcgagtcttgtcttgtgtggtttctcagtcttccctatatgatcgtatcagagagcgtcagtatgatgacccccatctacttgtcttcaaggacaggattcaatacggcaattccaaggaggtcactattgagtatgatggtgtgttacggatgtagggcagcctatgtgttcccaaagtagatggtttgcgtgagttgattcttcaggaggcccacagtttgcgattatccattcatccgggtgccgccaagatgtatcaggacttgagatagcactataggtggaggaggatgaagaaggacatagtggagtatgtagctcagtgcctaaattgtcagcaggtaaagtatgagcatcaccggctaggtggattgcttcagaggctagagatttcagagtggaaatgggagcgggttactatagattttgtggttgggctcctacgagtcttctatatgagtcttctatcccatcagaaacctcgttaagtcccatcaaaagctatatgagtcttctatcctgctctgccttgtgcatgctttcttttgctccacaagttcccacacaactacaatgagttttagcacttggtgtattcaactctttccatagtttcttcattttcgtgtagtaacatgtgatgtcaagaactccctgactcaaatcattaatctctttctggatttgatgcaacttagctccgttcgtctgatcatattgatcctccaattccttcaacaatacgaccgaattattcacatactcaacactgtctacaatgtcctttgccaaggaattcataatccatgaagtgaccatgtcattacacctctcccactgacaaaattgtggatctgccacatcgggccttatatactctccgttgataaagcctagtttatttttcactgagagagaccttaacactcctgttctccaggaatgatagccaacaccataaaaaaggataggtactaaagtagaacctgaaatatcagatagatacatataaagaggactagttgcatcaattaccatttgcgtggtcatcgccgtcgtcgcctcgtcggtttgatccagaaccaccatgagaatattgctggtcattgattattttgggacaaatcggctggattactgctcgcgtagccgaaattaagctcgaaaacttttattcactaacgaatcattggtggatgtgtcgatttaaagtttttcccaaattgtttgtttgcgaaaggaaaaccctagcttattctgtgattgaaaatgaaagaacaaagaagagattatacatcgtgatcaatgaagaagacatccgctctaataccatgtcaagattacaagatctaaatgagctctactcctcctccaatggaggattcaaaactctctagaatgtgaagttcgaaggtagagagagatgaacaatgaggagtctctgatttgggaaaagtgaaactcaaaatatctattactgaatattgtacactttatacacttaagcaactaagaaacgaaatataacatctgaactaactaagttgataggtggaacttcactaaaacatactaaaaccgactaatgctatgctaactcagcaatatgtatacaagtatgtataaatataaaatataatctcaatacaatctcaataatcagttgttgtaacagcggaagcagaaataaaaagaaagagcataatagccccttttacggaggtaaaggagtattgttgagatggtttagtattttcctttcttgttctttttttctcaaaggattgatagtattaataaatagagaaatcatgtacatgaccgagggagcaatcactagtcggcgttgaatcttcaggtgaatcttgctttactggcctcaagaaatatgaccatgagaacaagtttcatcataacatgagaggaatcaaaaacaccttctttttaatgaccaatcaaacaaaaataacctttgagcattcaaaaatttctggtgtaataggagcaatcttctaggtgttggattgcttatcccgtacgccaaacgagttaagtatgcaactggcccgatattgcctcgtccgaataattggtaccgaaaaatccaccgatgactcatttggactctccgcaaatactttcaaatatgaattttttaaataagatcttaagaatgagatagaaacaacaaaaaaagaaatttatggtggtagccgaatttaaagttggtggtggtagtggtgttctcagatttggaggagaaaatgatagtaatgatgtgaaatatctaaaaatttaaaagaaacatttaccggaaaaattttctggcaaaaagctattcattttctggcaagaagtatgaaaggtttgttaccatgttagtattttgtgccggttaaaatgttcaaatgaaacagatttaagatgaagtatctaagtgaaaagtgtggacaactttaagggatgtcgatgtattttgcctaaaaataagttagccttgattctcatttatttggtgctatttagttatttactagattactttgtctgtgcttacgtacgggcccaacaatctaaactttgatgaagtttgtttttcacttgttaatttgttctttgttataatttactgttgtattttaaattcaacaacaataatcacctagtataaattcaattaacctaattaattgttttatctttttactcctagaggaataaaaataattataggaacatatatgtatttctattgtcaactttttagaatattaatagcccgtttggccaaacttctaaaattagctaagtttgagaagtgtttttctcaaaagtacgttttaaaaaagtgcttttggtgaaaagtagtttatgtttggctaattaatttgaaaaatacttttgagcagtaattagtgtttggccaagcttttgaaaactgcttctaagtgtatttttctcaaaagtgcttttcagaaaagtgcttttggagataagctacttttttctgcttctctaaaactgcttctacttctcctcaaaagcacttttttttccttctaaacgcttggccaaacaccttaatttttgaccaaaagcacttttgaccaaaaaaaaaaaaagccttggccaaacacgctataagataagataaagaaagataagatacatgaaagtgaggaaataaaacatgtttctcaaaggcaaccaactctagatttatttttagaaaaatctcaaaagatgtaaaatgcttgaattaataatgtgaattttgtgtgctcattcttggttctagctctctttcttttagatatctaatttaattatgatgttttaataaattttgttattttagtttgttgctatgttataaaagtttcaaccttagatatttggaagatttactctcatttctatgtattttaaaaatttattttgtgacgacccaaagggtcatcatgtgttttattagccatttcgagcttcagaggccttgaaaacctccttattggttgcctcgatttgcgtgcgcagttcgagcgcgaagccggaaaaaattatatgttgaaatacttgaattatgtgtttaaaatgatgaatttcaagtataatattgatatagtagacttcggtcaacatttttggtaaacgggcccggacccgtgatttgaaaatttttgtagatccgtcataaaatttaggattcgtgcatatgttcggaattgaattccgaggtcccaagctcaaaatatggaagtttatgtgaaactagcttttgaaattttcttaagtatttgaaattgaatatttgattgttgaatgtcgtatcgggctcgtattttggttccgacgcccggtacaggtcttatatagtgtttaagcgctacctgtgaaatttggttgaattcggacgtcgtttgacgtgtttcggacccgaaaggctaaattgagagtttgaagttaaagtttggaaaatatggattttcatggttaaatccattgttttgatgttataatggcgatttgatcgcacgagcgagtttgtaggatgtttttggatcagtgtacatgtttggtttggagccccgagggctcgggagtgatttggttgggggtcgagttcacaattccatggctggaattgcagcaggtatcacagacctgcaggcttcgcatttgcgaagcctggttcgcaattgcgaacaggtcccgtccccctctgatctcgctattgcgagatgaaatatcgcaattgcgacgtccccttgtttccctcagccttcgcaaatgcgaaggaaagatcgcatttgcgacctgcccagtttcccttcaaccttcgcaaatgcgaaggtattgttgcatttgcgactttcctccttcttttcagcccgttcgcatttgcgaacaaagtctcgcaaatgcgagcctaccccttttatgccagagttcgcaaatgcgaacaattgttcgcatttgcgatgcccgcccctttagcctatacttcgcaattgcgaagatttgttcgcaattgcgaacactgacagtatatcacagacttaaacgtttttcaagatcatttctcatattttccaaacccaaacacacctctggcgattttcctctcaacccttcttcatcaaatcgtttgtaagtccgtttttactcagtttcttcaattattatcatcatctaacatgatttcttcctaaatctaaacttttcatgggtcaaaaatgaagatttttatagaagttagggttttcacatttttaacttttggacctcgatttgaggtcgaatttgtgaacaaattgcatattcttactcgtgagtgaatgggttgtcggaaattggttcgaccctcgagttttggccacgtgggcccggggtcatttttcactattcatggcagaatagtatgcatttcgtttttggaaatttagaacatgttattgagtagatattgatgatattaaatcaattatgtatagatataattgaattggaggcgaattcaaaaggaaaaggcattgcttaaggcttgaatttgctaagtttcgaccttcgaggtaagtgtttgatctatcctagcttgagggaataggagttgcgtctatttgttatgtgtagagtccgacgtatgggcatggtgacgagtatccatatgttgggggtcttgcatgaccgtgagtctctattatgcttatttgatattgatgcaacttttccacatttaaattgttgaattattaataatgtggaatccgtgaaatatgaattgaaatgaggatttctatggagcgttggctcaattgatgaaattggaaatttgttaaaagtgaatattaatgaaaagaggatttttatgtttccttggtggaacgcttatggtattctccttgtggagatgttttatgctatttgcattattttccttcgccctgatttattttgaacattaaattggcaaggaagagtgattaaagcacgaaggataatgccgtgccttgttataaatgattatgcacgaaggataatgccgtgccttgttataaatgattatgcacgaaggaaaatgccgtgccttgatatgagagtgtgggaggaaaagcacgaaggttgttgccgtgcattttatatgcttgtattggtgaggacgagagtaaaagcacgaaggttgatgccgtgcagatattaatttacttgtcctcttgtccattatcctcccatttttatatgtatattctgtcagtatatattgttgttattccagagcatgattcccttcccagatattaaatgttattttcctgtgatttttgtggtatatgtatttatgaactgtacaggtttatgtgagtgtctggtcctagccttgtcacttacttcgccgggataggccgggcacttaccagcacatggggtcggttgtgctgattctacactctgcgctcttttgcgcagatacaggttttggacagcagcagcagcagcgtcagtagttcttggatagcgtgagacatcgaggtagccttgcaggcgtccgcaggacccgttgtcttctctgtattagttttattctgttatctcatatgttcgagataaacagtgttgtatttctttcagactattgtgtgtattattcttagaagttcgtgagtattgtgacaccagtcttgggtagtagttatgttgagatttcggtaccgcatctagtaattttattaagtcttccgctaaatttatttattccaccgtatttatattatgattctgtatggtagtttgggtgattctctggcaggtggataggcccaattacagaggagactctgtcgaaatttttctaaaataagtattttttttaaatggaatataagtagagttggcttgcctagctcctactagtaggcgccatcatgaccccgatggtgggaaatttgggtcgtgacacctgtagagcttcaatcagtggaatgtttacctgaatttgcttgagcatctcaaagaactttttgtactgttcttccttttgatgcttggccaatctctgtgggaacggtgcaggaggtgttttcttcccaagcacttgggactttgtcttttcagttactatctcctcaaccggttctgcaactggttcaacaactttctctgtctcctgctaagtagtcttttcttcttgcacaggctggactgtcacctctgtcagccttgtggattcatctagctcgatgggtacctgaataagtgtctttgtctgtacattctcccgagctctctcctgttccatgtcaagatctctaccattgcgcagactcaccgccattagctgtttcgggccctgatccttaggatttgtttgagtgtctgcaggcagtgtcccatgaggacggttgtttagagccatagaaatttggcccacttgcacttcaatgttcttaatcgctgcgtcatgtgcatccactctttcgtttattttagcattggacccaatcacttgttgcatcattgcttctagcctggcgaacccatcttcctgcctcccaccatgttattgctgaggtgggtgatacccttgctgctgattgtacccctgaggtctaggatacagtgccatattgttgggaggtctcatgcctcccatattcccggcattgtattgctgtggaggtggtctgaacagctgttgaccctgctgtccccaattctgcactccttgcctctgacccccataatttgcaacataattcatatcttcaggttgctggtggtgatgatcatgctctacgttccatggattaccaagtggctggcttatgcaagaggtgcacaagcccccattagtagtatcaacgatatgcacctgttgtttctgtcttgactcctctacctttttggtgaggatgctcatctgggtcaatagagttgccatattttcagccatactgttggacagatcaagaggtactgagtgcaccactggagtgataggtgcattccgagtagtccaacctgaattctgagccattttatcgagcaaattttgcccttctctccaagtcttgcccaagaatgccccaccagcagaggcatccacaatattcttcatgctatccgaaagtcccatataaaaacgttgccccagcatctgctctggaacaccatgatgaggacacatcactaacattcccttgaacctgccccatgtctcatgcaaggtctccataggtttctgtttgaagctcacaatgtcatcaatttgctgagcagtcttgttgggcgggtggaacttgttgtgaaactgttttaccaactcatcccaagtttcaatggagttaatagggagtgagtttagccacacctgagcagctcatgccactgagaaaggaaataatagcagcctgattgcttccagagtcacattgggctgcctctgtgtcttgcatatcgataggaaattcttcaaatggtgctgaggatcttctatttgcatcccagagaaaagacccttgttttgcaacaagtgtagcatgttgttcgtaatctggaatgattcagcctgtattgtgggcacaacaatggcagttgccaagttgtcagatgttggttgtgcccaatcatataatgcaccatccggcacagggggtgccaccactctggcatttaagctatcttgttggttcctggcgtctccgttgggatcgtctgcattttccatttcagcttcgagtatgtctgtttgttgagatggttgagttcttttgttagcacgattcaatacccggaatactttctcagggtctgagagtccttcaagtagttctccagtccttgcagagtttctaggcatacacctgtgcaaccaagtcaaccgtcaaaagtttcaatccaaaaattgggtgtaaagaaactagctacaccaagaatttctgtaactctagcaatggcaattgataactctgtaaactccccggcaacggcgccaaaatttgatcacgcccaaagtatgccctctaaaaaggactctgcggacgttgcaaataaaacccgagtattacgcccagggtcgaatccacagagagttaacctatcagctaccaccttaagactcactcaaattctcgaaaccagcttcccaagactttcgaatcacgattggaggtttaattactaactaatatttggagtaaactaacaagctgaaaataaactactaaggttgtaaataatatgagagagagatgctaaggtcaagactttccctattgatggaatcccttttgtttatgcttcatacaaatttatcaacaatgaacacttagcttatcatgaatttcttccgaataatcacaacaatatactattgcactctcccgagatacaatagctagttttgattaatacagttcatttaacgttgcacccagggttttgttatttctaatcccgcctttaaacccgctgttatagattcctcttatactttaggagtggtgttattcaacaactacttaaatatgcactcttttccaagttatgcatactaaataagcacagttaattgaggatcctgtcaattaactacaacaagaatatagttgaataaatatagattaaaacaggcaaatttgcattaacataaactagaagttcatccctcaataggttccatcaagaccttagacaaaggatttagctactcataactatgggtaaacgcaataattgaatattcaacataatctagctataaaaataaaagggaaagaagaactacgttgtaaatattctctctaggtctaaaatatggcaaaagtactcaaaatagcatttttacatgtatttataccaagtagggtcgggcccggacgaaaataacccttttctgtgcgaaataggacaactctgtaaattttggcttgtcgcgccgcatgggtgcggcgtcccatgcggtgtgatagtgaggattatctaccgccttgtcttttgcttcacaggtgcacattgcactgtcacgccgcgcccatgcgacgccccatgtggcgtgacagtgtaaatttctcagagctagcctattttgtcttcgtttaacatccagagttggcacacgaccccgaacatgatcccggcttaatgtattgagcttttactcagacttcaaagcttcaaattgatcaatttagttccaaattaactattaatctccggatcgcttcctgcaaggcataaaacacgtaataagtgtaattcattatcaactaagctcaaacacgcgtaaaaatgcactcattggactgtaatattcatgctaaaacacgagtttctagcataacatcatagaccacctgtggctccgactactagtcgtagaaaaagaagtaaggtttggaatttttttgaaataataaaaggtactgatagagttagatgcaaaatttgtaacggtacttttaaacatttgactggagaaaatttaggggggactgagacgcttagtagacatatgagaattgaccatcccatagaatggggtgttgatggtgatgaaaatcaaacaactattaaccctactactggaggtctagtgaaatatgataaaatgaaggatcgtgaggagttagcaaaaatgattactttgggttttctacctttttctttgcttcttcagcatatcttattatgtatattcaaaggatttacaattctttatttaaaggtatccctaaaagtactcgtagagctgatatctttagacttcatggacaatatcaaacatacatacgttatttgtttagccaccttccttgtagagtttatctaacttctgatattggccatgctgttaatggaatgattatttgataattacatgccattggatagatgactacttgtatgcaaaaacgtattatcgcttttaaatgatgatgatcagagtcatactactgcgtttataagtagtactattgttgaagttgctgaattttataatctaaacaaaaaagtattgtgtatgccttttgataattcttctaataatattgccgcaattttaatattaaaaatgcatttgcaaccacctcttgctgaaatttttcatgttaggtgtgcatgccatgtttataatttaattgttaaaagtggccttgatttattttcagccgagattattcatgttagaagagcagttggtgttgttcaaggaaataatagacaatctagaataaagaaatttaagaataagtgtgtcgattataaccttaaacctagattcatgcaagacgaaattgttactagatggaattaatcccactatgcactgtaccacttctggtactatggatgataaagaaggccttgatagttttaatattttttctacattttctaacactcaaactagtagcaggaacattgatgaacttcaattctacttgcagaagcaaaaagagcctcgcacaaaggaattttcaccgttgggatggaggcatgacaatggaaagcaatttcttgttcttttcgctatggctcgggacgtgctgaatgtgccaatttctactgttgcatcggagaatgcatttagccaagcaagacaacaaccaggagacacccaccactcattgggaagcaatgctttggaagttttagtatgtttcagagattggattagatcagaacgaagaaatcaaggaaaggaagatgttgatagcccagaagacgaggaacttggagatatattaacacatgaaaacccatccgaatttaacattccagaagaaggtcaatcggttcatattgattatgatgaacttgctaagggaatgcaaaacatttgaaattttgaatttactactttactagtttacttgttgaaaaaaatattgtaatgacccgacccgtcatttattgcatcttagtctcgttacaccgtaatatgcttccccgaatgatgttatccgtgtttgatgagtttggagtggttcgggtggaaattagatagaaatgagacacttagtctctttatgaaagatttgagttggaagagttgacccaaagttgactttcgagttagagagctcggaacggattttcgaccgctcgactagttccggaggatgatttatgacttaggagtgaaaacgaaagtgaattcagaggtccggtgtgaaagttagttgagtttggcgaagttagtatttcggagaaatccggtggatatgtgagattttgattcgagagtcggaatgaaattccgacagttgcattagcttcgttatgtcattttggatttgtctgcaaaatttgaggtcattcggactagttttgacgtgtttcggcatcggttgtgaaatttgaaaacttgataagtccttaggcttgaatccatgcaaaattggtgattttgatgataggtgttgtgatttgaggcctcgactaggtccgtgatgtgttttaagacttgttggtacctttggttgagatcccgggggtctcgggggtgtatcgggtgagtacggacaccccggaacttagaaaatggaagttgcagtcagtggcaggcggaccgcagtcattttcgcgcggccgcaatgcctgggcgcggaccgcggtcatttccacgcgggccgcatgagctggggatcggcaggtcactgttccgacttcggaagctcataacttttgatctataaggaattttgagatgatttaaaaacgaaagttgtagccctttgtgtctagtttccagaaagctaaagaaatcgtaatttggacatctgtggagaaagttatggccaaaatggtgaagggtgtcactgcagtccacttccgtgcggccgcatgtcatttttgggcggaccgcacaggttgatgcggccgcatggtgtttttgtgcggtcagcactgtagcaatcagaggggtacttgtataaatacgagattttgggttttatttggtattttacccgtaggagctcggattttggcgatttttcgaaggtttttcaagaaattcatcggggtaagtgattctaactcaaatttgtttaaagtacatgaatataccattgaattcatcatttaatttgtgaattgaggtggaaaaattggaagaactagggtttggttcttgaaatgaaaattggggatttgaggggtcaaacggactccgattttgatgaaattggtatgtatagactcggggtgagacgagggtcattgtgatgtaaaaatttctgaattttgagacatgggcccggggctcgggttttgcgaatttcgagaattgtattgttttccgagttctttcaattgggttatgtcccattaacatcttgtaacatattcgatgtgattttgggcagattcggcatccattggggaaaattcgaaaggaaaaggcatttcgggctagttcttcgaccgtatcgaggtgagtaatgggtgtatatcttatccgagggtttgaaaccccgtattatcacattgtgaagctactgtgagctggacacgcactccatggtagtgcggagtcgtatatatgttgtgaattgtggctcggttccaatccgaggagtaaattatattgtgattagcgattgattcgctcttatatggataatttttgggctgaatgccacgtttggggccataggccgacttgaggtgtccttaagggactgaggtgattgtattagcatgacatgctcattatacattcattatgcatcatttgcattcatatggatcgggctacacgttccgtagcgggatactgatatggatcgggctacacgttccgtagcgggctactgatatggatcgggctacacgttccgtagcgggatattgatatggatcgggctacacgttccgtagcgggatatggatcgggctacacgttccgtagcggacatgtgcattgcatagcattgcattgcattgtatagcattcacttttatgcactctattgattatctgaggagtttcatcattgttttggttaaactgtgtaggtagcttcgtattgagttttactgtgttttcctgctttcgggttattatatatatttattactcactgagttggtagactcacccattactccctgcaccttgtgtgcagatccagggcagtctcaggcaccgtagatgcaggtagagctgagacaacacctgagtactgattcttctagatcagacggtggctaggagtaacgaggtagctgttggcgttcgcagccccgttttctcccttatcttttgttattgtattattccagacttgtaaaaatattataaattctgtagtagctcatgacttgtgacaccccgatttcgggctgagtcgggatgggttttgctattttgccacgtttatacttctgcaagcccttattatctgttaattatgtgtaaaaaccctgaaaagccttgaggtcccaggttcgatcccaagtggctgcagctgcggaggggtgaagctctgggctcaaggggaacaattcctgatgtgggaccactgtgggccctgtgtgggtagagccagtggtgggtttgagccccttgccttagacaaaaaggtgcctttttttgtaacgacccggctctaccccacacaggggcccacggcgtcgccggcactaccccctccaggggtagtcagccttaaggaattgttaccctcagccccagagtacacccctccgcagctgcagccacttgggatcgaacctgggacctgaggcttttcaggatatttctatcctcacctctcaccagttgagcagctcaattggtgagaggtgaggatagaaatatcctgaaaagcctcaggtcccaggttcgatcccaagtggctgcagctgcggaggggtgtactctggggctgagggtaacaattccttaaggctgactacccctggaggggggtagtgccggcgacgccgtgggcccctgtgtggggtagagccgggtcgttacaaatataaacctttcattttgtaagtttgaaactttaaattaagaaataaaagtagcacttgcaataagtgcaatttattttccatctacctagtaaaacttacgatatttataccaaacccggcccggcccaaccccctaaacccgtaatccgtacggtttaatttttacccgttataaatcgaacccgttaaacacgttaaggttcaacccggaactggcccgcctcggaacccgtaggggtcaaaaaaattttgaacctgcccggtctggtaggcccgttagacaactttagtttcaagtcaaacaagaggacaaccccccccccccctttttaattatttctcactcagtgttcgattgtatatttgggctcaactaaaattagatacacattgacaattttactttggcgggtaaaacagtttgccacttcccaacaaaagcgaattcatattctgaactcaaacttaacacttaaagacgaataaatatttataacttcattacaaaacttatcggtacggacaaggacaactctcttcatttgctttataactcaagaaaagtcttcaaaatacgagcgataccgaaactggaaaaaagaaatgagaagatagttaaacatagattcagttttcatcacttttgtttttcctgaaaagataaatacaaaagaagcttttttctttttgtgtttctataataggagtcttagggcacgttgggttaccaatattgggtaaaataatttcgttattaaagagtaatgtttcatacattattaaattacttaatcatgataagttaatataatttaagtaaatattttgcagacaattttttatcatgttattgccatgttactcaagaataaaacataattcatagcacaactaatatattagactaacactcatgatgtgtatacgtataacaacgataaaagtattttctttgagctatatcatcggagattattgaggatactaactttaatttatacttccgacaataaaactactattatacttccaatttttataggatcccctccagtagtacactgtccagtaatgcccaatgacttcttagatgcatgccacgtgtgcagatggaggttcaatgtcacgacccaaaatctaaccatggtcgtgatggcgcctatcgtgttacaaggcaagcctattcccaaaatattactactaactcgattataagaatttaataaaatattttcaacatttggatttctcataaactaaatgaactcttaatataattaatataaaatacggaagctagccccaaacattggggtgtcactaagtcacgagcgtctaaaactatgaactaagagatataattgtctaaaagaagaaacgacaaaatgagtaacaaggtcctgcggacactagcggctaccttgcaatctccttagatagccggcctgaactcaacgatcaccgcgctctaactcacctggatctacacataaagtgcagggtgtactatgagtactaccacctcagtagtgacagaattaactaaggaactgagcagtagtcacgagctaagaaaaatagtccaattattattttcacaatttaaaaataaacaggtaaattctataactcagtaaataccacaaagaaatttaacagataaatgcaacaaacaaaagtagatgcaacttcacaacaatgtcactcaatcactcagcactcaacactcaacactcgacactctacactctgcgcttactgggggtgtgtacagactccggatgggctcccaaagcccaagcgctaagcacagacaactcacgtgctaccatatcaatacctggatccgcacggtcaactcacgtgctacgcggacaactcacgcgctatggtatcaatacttggacccgcacggtcaactcacatgctacgcggacaactcacgcgctatggtattaatatcctcacaacttggccctcggccttactcaattatgtacctcactagcctcactagcctcaccatcatcaacaaataagggaacacagcccacatcaagtatcacagcatattagcaatattagagactaaggtaaatatgactgagtaaaaataatgtaagaatgaataaagcctaagcatgatctctaacatgaaggttatacagtttcaacaacaagtaaacacataatcacagataatagctattatgcctcgcatctcacgggacggaccgagactcaatccctcgaggtatacatccacacgcccgtcacctagcgtgggtatcacctccaaacaatcacattatatcaaattctccgggtttataccctcaaagccagagtgaaaattgttacttacctcaacaacgtaaaatcctacttcaagataccctcttctctggactcggtatccaaaagtttcgaatctaaccagaatcagattaatatcatcaacatgtgctaaagaatcgaattccacaataaaaactacaaaatataccaaaaattagaaatcggccaaaactcggcccccgagaccacatcccgaaattagtcaaaaatggcagaatcataaccctcgttctctcccgagtctaaccatataaaatttatcaaaatcggactccgtttggtctctcaaatcctcatttaaaactctccaaaactcaaaccctaactccctcattttcactttgaaatcatcaatcaaatcccaaaaacgaagatgggttcatgaaatataattaaaatcaagtaaagaacacttaccccaatccctatggttaaaatcgcctccaaaatcgcccaaatccgagctccccaactcaaaatatgatcgagtgaacaaacccttattttataaattttttgccagctgttttgcctcgtttctcgtgtcaaacaatctcaaaactcgtattttataactccaatggatttcttgtgaaattctagtcaagtcaggcttttgaatcactcaatttgaccttataatgaatgagatatgtaggttttaatatttgcaaatagtgcagatttttaaagagaaaattacagcccatgtcacttggcttaatagcccaacaaaaaatgacccacatttgaagctcttaccctatatagcccatgttgtatataacttgaaattttttttttcagcctttagcccactattaaagacatacttttagggtttttattattttcttcttttctttattcccttctctctctcacagcatgttgtttttcgcttcttctctgactcacagttgttgattgcttctaatggaagtccaaattcaatgtttaattcgcttcaatatatgaaggaatgctttcgcttttaaagtagtttagtcagattattctttccttcattttattccggattcacttttcatattaactgagagtttatctagtctatttcgacaaatcaagtatttctccgagtattttgaaataaaaattaggactctcttctttgacagttttgttgttgttttgtttttgtatttcgaatttgaagtccaaggctagggattttccgttcacaccccgtcgcaacagtaacagtagccgtcgccagtggtcaactccgacggacggcggagaggacgcaaaaagcgagggagttctggaaaatcaaaactatgtagcaggttgtatcgacactgtataatagtgtgtaagtctgtatatggatatacagacacctcttatacactattatacatgtttatacagtattgtataattgtgtataaatgtgtataagtgtgtataatactgtataaacatgtataatagtgtatatttgtgtataatgttgtataaatatatattttttaagtttataaggatgtatatacattgttagcgtgtaagaggtctctacagaaatttgacacttctttctcttcttcttttacgtttggaggattctacaatacatttaccaattttttatttttcttttatcctgttggaagtgtttgaatttcttaccttcagataatatgtattattcagtatttttgtattgtgttgtggctgatttgccaagcagcagatttgcgagggagcaaataagcagtctttcaggaattagccaattattttttgggctatagatttgcaaagtgatatctaggatattatgttgcaaggcagctgtgtgagttgtacttatgtgaaattatcccatttttaaatacgctgctagtggcaatttcgtaattaaattgaaaaatatggcaacctaattcttagtaaaatcgacctaaaatcctcatacaatgtccaaattcgatcattacttttgctacaggtccgtaattactatacggatctaatgcttcaataaaaaaaagaaatcggagctcatttgttcaatataatattatttatacttgaagaaacgacgttgaggcataagaattactagcgctacataacccaaacctatatgaaactcacccgaggccctcgtgacctcaaccaataattttaagaattcatatatcactaccgaacctagtcgaacctctagaacgcccaaaacaacaccaaaagaccaaatcaacctcgaattcaagcttaagaacttctaaacttccaacttttaccaattcaagcctaattctaccacggacctccaaattacattctggacatactcctaagtctaaaatcacctaacgaagctaatcgaaccataaaaatccaaatccgaattcgtttattcataagtcaacttccgattgacttttctaacttagctttctaactaacagactaagtattcgtttcactccaaaactactccgaacccaaacctaccaactcaatacaactcaatatagctgaataatacataaagaaggatagatgggggaaacaaagctataactctcaaaatgaaagaacgggtcgttacatcctccccctcttaaacaaacgttcgtccttgaacgagtataaaaatataactagagtctcaaataggtgaaacattcagcaataccttctcgtcacattcaaatcatatgaactcatctcgcggtcgcatcatactaatcacgtacccatcaagggaatcacaatccgtcgatgcacaattgatactgagcactcatgtgcgcatacgaatgtgtggaaggaattcaaaaagttacacttcaagctgaatcaataccgcacgataagaattcgagaagatgaagttttcctaaaggttctgcagtctctcgaagataagtacagacgtctccgtaccgatccacaagactctactaaacccgctcatgactcgtcagacctatgtaacctaggctctgataccaacttgtcacgacccaaaatctaaccatggtcgcgatggcgcctatcatgttacaaggcaagcctattcctaaaatattactactaactcgattataagaatttaataaaatattttcaacatttggatttctcataaactaaatgaactcttaatataattaatataaaatacggaagctagccccaaacattgaggtgtcactaagtcatgagcgtctaaaactatgaactaagagatataattgtctaaaagaagaaacgacaaaatgagtaacaaggtcctgcggacactagcagctaccttgcaatctccttagatagccggcctgaactcaacgatcaccgcgctctaactcacctggatctacacataaagtgcagggtgtactatgagtactaccacctcagtagtgacagaattaactaaggaactgagcagtagtcacgagctaagaaaaatagtccaattattattttcacaatttaaaaataaacaggtaaattctataactcagtaaataccacaaagaaatttaacagataaatgcaacaaacaaaagtagattcaacttcacagcaatgtcactcaatcactcagcactcaacactcaacactctacactctgcgctcactgggggtgtgtacagactccggaggggctcccaaagcccaagcgctaagcacagacaactcacgtgctaccatatcaatacctggatctgcacggtcaactcacgtgctacgcggacaactcacgtgctatcgtatcaatacctggacccgcacggtcaactcacatgctacgtggacaactcccgtaatatggtattaatatcctcacaacctggctctcggccttactcaattatgtacctcactagcctcaccatcatcaacaaataagggaacacagcccacatcaagtatcacaccatattagcaatattagagactgaggtaaacatgactgagtaaaaataatgtaagaatgaataaagcataagcatgatctctaacatgaaggttatacagtttcaacaacaagtaaacacataatcacagataatagctattatgcctcgcatctcacgggacggaccgagactcaatccctcgaggtatacacccacacgcctgtcacctagcgtgggtatcacctccaaacaatcacattatatcaaattctccgggtttataccctcaaagccagagtgaaaactgttacttacctcaataacgtaaaatcctacttcaggataccctcttctctagactcggtctccaaaagtttcgaatctaaccagaatcagattaatatcatcaacatgtgctaaagaatcgaattccactataaaaactacaaaatataccaaaaattcgaaatcggccaaaactcggcccccgagaccacatctcgaaactagtcaaaaatggcagaatcataaccctcgttctctcccgagtctaaccatataaaatttatcaaaatcagactccgtttggtccctcaaatcctcatttaaaactctccaaaattcaaaccctaactccctcaatttcactttgaaatcatcaatcaaataccaaaaacgaagatgagttcatgaaatataattaaaatcaagtaaagaacacttaccccaatccctatggttaaaatcgcctccaaaatcgcccaaatccgagctccccaactcaaaatatgatcgagtgaacaaacccttattttataaattttttgccagctattttgcctcgtttctcgtgtcaaacaatctcaaaactcgtattttataactccaatggattccttgtaaaattctagtcaagtcaggcttttgaatcactcaatttgaccttataatgaatgagatatgtaggttttaatatttgcaaatagtgcagatttttaaatacgctgctagtgacaatttcgtaattaaactgaaaaatctggcaacctaattcttagtaaaatcgacctaaaatcctcatacaatgtctaaattcgatcattacttttgctacatgtccgtaattactatacggatctaatgctttagtaaaaaaagaaatcggagctcatttgttcaatatgatattatttatacttgaagaaacgacgtcgagacataagaattactagcgctacacaatccaaacctatatgaaactcacccgaggccctcgtgacctcaaccaataattttaagaagtcatatatcactaccgaacctagtcgaacctctagaacgcccaaaacaacaccaaaagaccaaatcaacctcgaattcaagcctaagaacttctaaacttccaacttttgccaattcaagcctaattctaccacggacctccaaattacattctggacatactccgaattcgtttactcataagtcaacttccgattgacttttctaacttagctttctaactaacagactaagtattcattttactccaaaactactctgaacccaagcctaccaactcaatacaactcaatatagctgaataatacataaagaaggatagatgggggaaacgaagctataactctcaaaatgaaagaacgggtcgttacattcaaaggcttggatctagtttgtacttgcatttcttctttttttctatttactttatcaagcaaatataatatttttaaccatcaagtgatgtggtgcagtggatgaggctgctcctcccttaactagaggtcttgagttcgagccctgggtatggaaaaatccttgatagggagcgctaccccccgaatggggccttacccggcgcgaattcggatatagtcgggctccaatgcgggtaccggacaccgggtgaaaaaccaaaaaaatatatataatattttaaaaagtaaaaaattaaaaatgcatgaaattttacactattttctccttctttgtcttctttcacaaagtggtgttattcaagaaacttcattgattttttttaaattctaagtgatgtccaataagacttggcaatctaaaaaaatataagatgggagtttgggtatttcaaatttgcataacgggaaagtgtagtgatttttttaaataaaagttttttgatgtgtgtacgcatactttaccactacctttaggtaaaaaggttgtttccaaatagacccccgcggcattctttcctccaagaacttcccaccttgctcttggggagactcaaactcacaaccttttgattgaaagtaaaagttgcttaccatcatagcaacccctccatgtctgtgtgtgaaggaaatcctaagggtcaagaagaagagagcaaagttcgtgggttggggtttgggaaggaaaccctgccattttttattttttactttttaaattattatatttgtttaataaataaaaataaggcagcataagtacaactgaatctaagcctttgaaactccatctgcacacatggcatgcatctaaaaaggcattgagcattactggacagtacactacttgagcggatctcatcccattttctagggccccattttttaataatagttactaattgaaggactttttttaaccgatatacatagattatagtatataattattttttttatttattatatatatatatatatatatatatatatatatatatatatatatatttggtggacgattattcgaattaattcttttatttttctttataaaaatattgaattaaaatagaaattatataaaaaaaaactcatattaatatttgactttcagccacaaattatatcgagctgcccctagatgtacgtaagccacttggtcatactgatgtgttataaggacaaggtttaataaatggttaaccactagtatgaataatggaccctcaggaatagtaaaaataacatgggctagtcggtgtttgcaaactttctgagaaaatagccactattttatgtagagacaaaatttagatagaaaaaatactttagctgaaacacggaaagatccatcataatattttggaatatggagttcatgcatataaactttcagcatattatattggaactctaacacattatgaaattccaacacaatgctgaaatctcatatgtaaaaaaattcgacctccggcatattatattgaaaattttccggattttaagggtgtaaatcaggctttttttaaattttcccacccggtattcatatcaaattggaattcgattaatttgaacttgcaccgaaaagtttctctttagagataaagtattttttactaaaggcaattttattcttaactcgaaatttcaaattaaaaataaatatattaaaattatattattgaattgatataaatgtcgaatacgaacaaatgtttaccggttgagcggcgtggcgtctgtgaatgcaatttgtgaaaggcaaaaaataaagagtctttgataagtcaattgataagtgactgtttgacatcttctgctgcattatctgtttcttcactcatgttttaatttgtaggccagcaacgccttgcacgtcgtttgactcttccgattctctatgaaatgcttttgtgatatatatatatatatatatatatttatatatatatatatatatatatatatatatatatatatatatatatatatatatctatattatattaaaagcatgaagtcccttagcgaaatatcgttcgccttttttatcctttaaaaatatatttcacactagacacaatagttattttattatttttactaactaatataaggaatactcattaatttattttccttatatttaggaattcaaaatctaactaaattttttgtattgaattctccattgtttaaactaggtaagactatatatttgtaaaataaaagaaacacccaaaaattaaagtaggaaagtttcgtccacttgaactcttttaagatttagtagtcattattctttgtatagaatttaactaattactcattaataattttagtaaaataaaatttaattaaaaaggaataaaaaactacagatgaagtctcgtgcacatagaaatcccttttaggtttaggaattctaatgttataaaatagtactcttttagcgtgaatatttcaaagagtattcataatctaccttacaacaagtaactaacagtttctctttttcaatttatgtggatgtacatttcaaaaaataaatgacaggactacattttgaactataactcagttatagtgaataatataatgtacattgttataaaacaataaaagaagaagaagaatattgcagagcaaagtagacagagaggaaattcttattgatatgggatcaattacaatggaataaaaccctttatttatagggagatggtgacttagccaccaagtagtaaaccctagaatctctctaaatatagacattcaccataaatagaattctatttataacactcccccttgaatgtctattcaatagataatgtgcctcgttaaaaccttaactaaataaaacccagtgggaaaaaaaattctagagaaggaaaaagagtacacatatctaataatacgccttttggttgcctcattaaaaaccttataaggaaaatccagtgggacaaaaccttataagggaaaaagagtacaacgcgcattaactccccctgatgagagcatcaattcacatctttaagcatttgcattccaatcttgtgcaccatcttcaagagatagttggtagagatttgataaataaatcagccatattagcttgaatgaatattttgcaccttgaaatcatccgtcatgataaatatataatgtcttcacaaatattgtggaatgactcttcaatatctccatagaggtatcctctctatcacattatcatgcttatagttatagcaagatatatttgtgcataaactgctttgaggaagtggtacctcaagatcaagaattgtagatgcttcaagcaacttaaatccttcatggattgtcatataagttaagtcatataagccatataataaactttagatacatatcaagtttttcatgtcatgctagacaaataagataccgaaaactgattgtacatatcattgactttatactttcaagtatttgaactgcaggtccaaaacaacatgtctttcatatgaaaccaattctacttgaattgtttctctggacttaagatcctcatctattcttagcgctatcatagatgtcgtcgacgaacattttatatcggttccaataaattttcataaagacataacatagagatcttcattcatatattcaggtacctgaatctctcatgagattttatgaagtgttatgtcatttgatcttctagatcacttgcctccttattatgatcactttgatcatttgttcatcttctttatcaagaagttctatttgaaaccgatttgtctatacgctttaagcgtatcatagactttgtccttctaggacttaatatgagcattttcaatgagaatatagttactttctttgggtcagcaaatgcatatggcatgctttgcaatatattgcaaacggattatctttttatgaacttcaagttcatattatcttattcgaagatctaaatgtacaaataataattcattccacgtaactttttctcaactgtttatcatgtctccccctcatgttagaaaaactaacttgtttcctcaactttgggaacccatctttttgcgttatggtgttaatcaaaatatacaccgcacatcaatagtaataagatggaattatttggttcctgaccctgaaccactttgaggggagaaaataatatactttcgtatataacatatatcaaattgatatagataactttgttctcataagcaatagtttagctactaagtggagacactcaataaattattttgttaaaccaactgtgatgtaaaccaacttatcaagatgaactatcttgaataaaaaatctgaaaattatgctttaaatcaaattattgagcaagttacctcgcaaacaccatgttgcgggttaataataatcgcacatgtaaccatctcatatatgcatcttatgtggtatacatgacaggtgaatggacccatattcacctttgatatttccagaattcatgggattcaatcccaactttagttggtctattaattaatgagaacaagaaatataagagaattcgtaaagaactttctagttctttaatatttacccatgtgaattctctattatttttgcacatcatacttaaattgatatggctaaaccaattgccaattgaataaattatcaatattgataaacttcaaatttacacaatgacgtgtgcaattatcaataaactccaagtttattatgatatgggtttttatatcaataaacatccactttattgtggtattcttttatttgtgtagtacaaactgaagaataaaacagaacttttcacataaatattatcccgctacaagttgtagtaatagaagatattaaatcttcctttatttatagtctaaatataaccaaccacttttgcgaatactctagaaactaaataagtttctttgagacttactacaacacaatatcttattgataatcaattttatttctccaaaatagtataattggctcttctagagctctcaattaattttgtactaccacatattcatcaacatctatatggtgaatatctctttcaaagagaaagttataccattgtggttatggtcaaaattatatgcaagatatgtttcttgcattaatgctattctttaataatcacattaccaaaatattttggctacaataggtacgtgaccaatgaccagtcatgccataatcatgacattattttcttgtatcatctcaaacctccttctagaggtgagtgtggtatattcaataccaatagcatgttcatattcttccaagaatgaatatgtattcataaattagatgttgtcacatttacatcatgaatggaccataataatctatacgtgctttacaaaatctcatgtcaaatcgatgacaaatattactttcataaagtgaaagattattttgagaatccttattattctcattatcacaatgatgacgattataatttcgtctattgccacgtccacatctattgataccttaacggtaataatttcgtcttctttcagacttatcacatactgctatcacattctctaaagggaatgagaatggagcaaattcaatgggacgggttttcaattctttgcccacaatcatacatgaatttaatcatggcaaggcatagaaattttaccacttcatgtggtgtaatttcttacaaactccattagagttataatcaaactttgttgtctttacttgtatataaaatcaaattatagaatttcaagaatttgaaagagaaaagtaaaatacttaccttaaatccagaattttaatcatgaaagaagttcatggaacaattgacaattattatgctcaatctcaaagcttctactcaattggttagagtctcgtgctgataacgtgttataaaacaataaaagaagaagaagaatattgcagagcaaagtagacaaagaggaaattcttattgatatgggatcaattacaatggaataaaaccctttatttatagggagatggtgacttagccaccaagtagtaaaccctagaatctctctaaatatagacattcaccataaatagaattctatttataacatacatcaatttcttttgtgaacttatacatgttaaaacacaaacccaattagataaagataagatactaaatatatacatcaaaattatcagtaataaattgtacgtatatctttaaggtaattataagtttattgacttttagcacaagtaatgttatttaggtctgtaatttaggcattaaaaatcagtatgttctgctattttaggtcaatatcattacatgaaatataagggtttggtgggttcagggtccaacaaccagatcgattgtgagtttcctagcccgattttttttgtcgatacatttattattttctttcaagtacctatactttttattattatatatttattgatcttattatattatattataattataaaagcgaaaaactccactacaaaatattaataattttttcacttttaaaaattaattttacattaaataaaattatcatttaattagatttgtaatatttaacactttaaaagtagctgttgtattttgcttttacaataataatttattcttttctaatttgtcggaagcaattcatatagaaaaacttgcatattttgcttgggagaaagaaacaaactgtcttacgtcagttacccgatcatgtttgtgtcttctagaataaacttcaaaaaaaaaaagaataaaaatgaatgaacttgaaaataactttccacaaataaaaaaaataataataataatatttacaccttcaaagggtatgtgtttttgctcttaatatttatgtcaatttttttcaaaaaagttatcatcgagatagatacacgcgcgatgcgcgtatactaagactagtatatatatatatatatatatatatatatatatatatatatatatatatatatatatatatatatatatatatatatgacataagaaattttcccttttttacaaaaagtttttgcttttttcgaaatcataaaattttcaattttcatttgaagaagcattttgaaaatttttgaaaatttgaaaaactccaaaaagttatttttcaaaattttcactcaaatcactcacaaaacataaaaaacaacccaaaattatattcatgtccaaacacaattctaaatttcaaatactattttcacttgaaacaaaatttaccctgaaattttacaattcttatgtccaaacgcccacattatatcaaaaatactttttattgcataaaaagtactttcttcgtttcaatttagatcttggctcaaagtttaataaaaataaaaagacttttaaatcatgtaatcgtaaaaaaaatagaatttaaatttattctttgagaataagcgtgagttcaactctcaagagagggggagcgataatttaaaatttatggatttgagtttctaccccttttagtttcgggattttaaattaatatattttatatatttaataaattacttataaaataaatatataatttgaactaaatctattgcgtttggccaaacacataacttaaactctaacttctcccatttctcaagactctcttcattctctttaccggccacttgtggaccaggtttcttcgtatccaagggcagagggagtgtagaacctatgggttcgaccgaatacagtagttttggtccaaattatgtatttgtcttaaaaattatattgaacattaataaatttaaaatttattaacttaaaaaaaaaattaaaattttgaactgataagttttaaattatggttgtgcctctgttttgtatccattggtccacaacaattaagcaccccggggtccggggtacatttttcctcacaccttcaagtagtaccctttccttcaattatttatgcattcaaatcttactataaatagaacccaagattacatcagtttcttcatcccttaatttcaaactaagctttgaacaaaaaagaaaatatgggttctaaggcatttctgtttcttggcctttgtttggttgttttcttcttggtaagctctggggttgtagctgctgagttggctgagacttccaactgtaagcttactttcatttgctcccattgtaattttactctgaaaaaataaattcttttttctcattatttggtatatgatttaactaattatatatgcgactcttcaataaatttgtacaaattgatgtattttaacatgttgtaacattctttaacctttcaaattagtgtttatcatctagtaaagctcaacttgatttctacatcgagctagtagttgagttacacttttgtatttactatcactatagattgataataactcttaatatgtactccttctacttcattttgtgtgtcttaaattgacgggacagaaagtaaatgtaagtaaaacgggtaaaataagaatagtggaacttaaaacttgtttattgagtaaatatagaaagaggtatttgaaaatgtttggacatgaatactatttggagccgttttttaaaatttttgtgagtgatttaatgtgaaaattttggaacatagtttttttatgtttcaaattctgaaaaattttgaaatacaattcaagaaaaacttgaaattttcatggccaaacattaatttcgaaaaaaaaagaaattttttttatggtcaaacggaccatgttttaagtttcacaattgatgcagcaatgaaatcggataacgagaatgaagtacacgttgacggacgtagcggatacaatggcgttggcagtgatggatattatggaggtggcggtggtggtggttataaacgcagaggatgctactatggttgctgcaggaaaggttaccatggttgcaaaaggtgttgttcctatgcaggtgaggcaatggataaagtcactgaagttcagccccacaactgattattatatgtaaagagtttaagttatatataccgttaatatgtataactttgtatgcactatgtattgacaagatgtaataatcttgctactttagaccttgcttgtaacaattatgaataaagccattcggttcttatggatggttggtcatgtaatgttttgttgtacaatatattgtgataatatgtttccatattattgtttattttcttcaaatttagagtaaaggtttttcttctattttatgaatcctacaattctcttttaattctttcctcgaatttacaattcaagtagagatggagctacaatacaataaacgggttctggccgaactcagtaactacggtccaaattcgatatatttattgtaagaaaattattaaatatgtacaaacaattaatataaaataaaataacttaaagagactaacaatctcgaacccataaaattttaaattccggcgtcacctataaacatccaaactactctaaattatcaattaaaagacagaaaaaagcagatccactatttaagtgtggagaataattagaaaacagctaggagtgtactgggtggcgcaatcatattatttgcagttacttctacaaaatttatcaaattgagcaataaaaatttcatgtactttagttagtgtctgttcgtaaaacttttttccaagttgtctttatagtatattttgattttctatatattataactaaattagaatggtaagacttacgtgatgttccaaaattgagtattatcctagtgaaagctgacatctctctcgaaatgagaattttacttagggggtgttgaatgggattaggctaaattaaccatctcaatgtttagttgggcttgatgggctcaatcgacatgagttaaataatgagtaataactttaagagtaattttcaaaaagcacaatcttttagtagtaattagccatctatagatatcatttgctatagatactttttgtgtggttataaaatgtatttgatgtatttaagctattatattcatgaatacagtagcaaaaataggcttgaatcagggaagtccagctaatcagttattgtattcgagtgtattcgactgtattcatggagtgaaacatgggattacagctggacagataattgtattcaactgtattcgactatattcaccgcgtgacataagggattacactatttttaaaacggaaagtgaatcaattaacataatagactcctaatataactcaacaaactcaattataacacacaaattttatattttcagttataaaaaagattcccaaccgaaaaataccccaaaaacataacaatcttcagagaatttatataatacatctgaatacataaattatattaattaaaaaaatatatgaatacgttaatggaatatagcgagccagtaaatataatgaaatagatggaatacaacgggatacattgaaatacaataaaaaaaagacaatgaatacaatgaaatacatagaatacattgaaatacaatgaaaaaaggtaatagactcttcaagttgctcagccacaaactccgtcgtctttgttcaagagtaaccctaatatcgtctcgtcgatagcagatttcgaacctagctatgcgaaagttttattgtcagccccaatttgttgtttatcttcttatccaaatgtttaaaggccaccgctggacatattggcacatattgtgtttatgaaaattgcattatcttacacttcaagcctttgaatttggtgcactgtgtgccgatagaaacgtttctttttccggtgagtttcagaggcatcgccgccaccgctgctggaggtaaaaccgcctccggcgtcgccttattccattgaggatctttactaggagaaaagagaaatcaataaaaccttggataaaatttaagaattaaacttaccctaagcacttgtatcggctctaaaacagtgattttagagagaaaagaaatagggagtgataatggcggagacctagagaatttgggtgggagaagagatatgaatcgtgggtttgtgggagaagagagtaaagtgtatgcaaaaagagagagaacgtggttagtaagatttatggtgattatgtgagagaaaaatattattaagcatatattgtgccttaaatgtaggatgtaactataattagatattttgctataaaggataaaaggtatttataggatataatattttaaaatggtatttatttaaaataaatagggtactaagcttttctatagggtgtaaaatttcctaacttaaatgcccatccgctcttaaatagccaacaaatacaattaatgtatttctactatataagaagtgagagtgcattaggtgaagccgacatgacttcatcgacattccagcttcagcttttatatttttgcccttgttttttagtattattacatttgttgccatcgaagaatttagtaaataaagcaagcttttgaggtatttttaaagcccactttacagctctaaaatttacatgttttgcatcttcttagtctcattcactgaaacctgggagtttactttggtcattgattcattggtgataaatgataatctacgtcaaaacttatacaccctctggtaagataaatgttcttccttctcacagttttgtgttgcaacgacttttcttagtagaaagtagtgaaatcaaaaaacccagcagagcactgaatgccgaaagcaaggaatttcaggtcaattgataagtgtaacacgacttcgcactaatttttaaatttctagatagaaagttaagaattttactgataacaacgaaaatcccatatttaactcaatatctaacagtaatggagaattcatgggaagggatattgtaaaagtaggattctttttggggaaaattggtaaatcgtgttagggtttgtgaatttcagaaattgataaaacttggagttttatcttcttcgtccttaatagtccagaaagaggatcgtcattcctgtagctaagggtccaaagttaactcctttttactgtaagaccttcttcggcgtttcatttgcaattagtgctgtatggtgggccggtcccgggcctaaacgggcttcgtgggccggtcctcacggtccccgggcttcgtgggcctgggctcaagcggtcccggtcttggtggtcccgggcttcgtgggcctggcgggtaagaccagcccgtgacgggcctaagaccatatggtcccgtgcttggtgggccgggcctcgcgggcttcgtgggcctggcggttttttttttttttttttttaaaggcaatatcttgtatagtagttagtattattagtatagtatataataataatatataatagtatagaagtatagaatatatttataaaacaatagtcaaattttgaaatttgaattttgaattttgggaatgcttgttgtatatttgtagtatatattgtatatagtgcaagtaaatatatattgtagtataaatatttatattgtagtatatattgcaagtaaatatatattatagtatacttgcaatatatttgtgacgacccaatggggtcatcaccataaatgctccttgttccgtgcttctgaggccgcgaaaacctcttgagaggttgcctcgatatgcgtgcgcagttcgggcgcgaagccggaaagattttctgtgatgaaatatgaactctgtgtttaaaatggtgaaatttaagtataatattgctatagttgactccggtcaacattttgggcaaacgggttcggacccgtgtcgtatcaatttctaaatatccgtcattaaatttgggactcgtgcatatgcccggaatcgaattccgaggtcccaggcccaagatatggaattttctgtgaaaatagtttctgaaaatatcttaagactttgaaaatgaattattgcttttaaactatcgtatcgggctcgtattttggttccgatgcccggtacaggtcttatatggcgtttaagcgctttctgtaaaatttcatgtgatttggacgtcgttagacgtgattcggacttggaaatggaattcttgagttttaagtgttaagaagtgaaattgtgattttgaggcttaatcctatgttaatgatgttgttttggcgatttgatcgcacgagtaagtccgtagggtgtttttgaggttgggtgcatgtttggtttggagccccgggggctcgggtgagtttcggataggtgttagggtcatatttctgcatttttacatctggtgtctgcagtcttcgcaaatgcgaagtaatcctcgcatttgcgagtccctccctttgcctgcctcttcgcaaatgcgaagtccatcccgcatttgcgaacaccctcagttttggccagacttcgcaattgcgatatctatctcgcatttgcgagttttccccctgatcctcagacatcgcatttgcgatgtcaatcccgcatttgcgagcttcttcagtcctgtagcctgttcgcatttgcgagttttatctcgcaaatgcgaggtttccctctctgaccctccagttcgcaattgcgaactcaatctcgcaattgcgagatctgcacctgttatatctgcacttagacgaattttgaacctcatttcataacatttcaaaactcaaaactccttaggcgattttcctcccaacctctcttcatcaaatcgttggtaagtccaattttactcaacttcttcaatcatcatcatcatctaacatgatttcttcatcaatcaaagcttttcatgggtcaaaaatggtggaattagtagaacctagggttttcatattttgagcttttggacctcgatttgaggtccgatttcaattccaatcatagttatggattcatgggggaatgggtaacttagttttggtccgaacctcgagtttcgaccacgtgggcccaggggtattttgggaaattttgggtaaaactttgggaaactcatccttatgcattcaaactagtttaattagcatttattaattcatttgggtaatttatgactatatatcgttgtttgggagttggattccaaagggaaggcggtggtagagctttgaattgcaaagtcggcattgaggtaagtgtttgttctaactctagttcgagggattaggattaggaagttatttgctatgtgttatacgggtcggtgtataggtttggtgacggttacctatgcacccgagtcaaaaacatgaccgtgagtctttatttaagattgtcgaaagctatgttatggaatttagctattgaattgatacttgtgaatgacttgtgggaatcatatgacctaaatagcttaattgaaaggttgaatgaaaaatcatgtctacttgagttgaattcgaaataatctctatataccttgccgggttggataagtatatgtgaattgtttgtgttttccccataatgggtcttatgtgaacttgaaatgagggcgggtggtacgcctaccacaagacacattgaaatgagggcgggtggtacgcctaccacaagacacattgaaatgaggacgggtggtacgcctaccacaagacacattgaaatgagggcgggtggtacgcctaccacaagacatattgaaatgagggcgggtggtacgcctaccacgagatgtgatttaaatgagggcgggtggtacgcctaccacagcatatactgaagtccacttgtacttgatatgtgtttctttgtcggttattgattatttgtttagctagtcgcattttcatttatttgaactgtttcccccttatatagcatgttccctcccatacttggttaattcatgcattattttttctgtttcgcacatatatatatctgtacaggttaacgttgtaggtccggtctagcctcgtcactatctcgtggaccggggttaggcaaggcacttaccagcacatggggtcggttgtgctgatgctacactttctgtgccttttgtacacagatacgggagcagctttcggacagcaatgccagcagtagatcgggagcgcgccttcagtccagagactattaggtagctcactggcgtccgtgggtccttagtctcttccgtctttgttatttagtccattgtattcggacaagcatttcatgacatttctttctttgagtcgttatttgtagtaactcctagtacgtctgtggatactgtgacactaagttctgggtagaagtcagtagtttaatctttattccgcattcgggttatgttatattctatatatgttgttacttccgcacttgatcttccgctttcatttcatattgttaaattgttaagttattgttatttcgttaagtggcttgcctagctccctcagtaggcgccatcacgaccccccgacggtgggaattccgggtcatgacaagttggtatcagagcactaggttacttgagtctcacagttcacggacaaattcggtagagtctgagggatcggtacggagacgtctgtatttatcccccagaggctacagagttaggaaaatctcactttattcattcgtgtcgtgcgattctgtttctcaaatattgatcgtctttctactctgttctttcgcagatggcgagaactcgagcttcctcttcttccgatcagtaggctgatgccccagcagcagttccagttaggggcagaggacgaggccgcgctagaggccgtggcaggggcagagctcagccccgagccgcagtgccagaggtggagccccagattgaggctgaggggactccagccccagctattcctatggtcgtcccgggtctccaggaggccctagctcagatcatgtcagcgtgctctagtctagcacaggtggtctcagccaccgccgcagttgccacttctcagactgggggaggtacccagaccccagttatgcatacacccgagccagtggtgcagggacttcagactccggaggcaccgccagtgcagtaggttgccccagctccttcagttgtgccagttcaggcagttgctgtgggccagactagtgatggtgcggcgatgtccgcggatgctttgtggaggcttgatcgtttctccagattatttactcttacctacagtggtgcaccttctgaggatgctcagaactatctatatacttgtcatgagactttgaggactatgggtattgtggagactaatggagttgattttgccactttccgcctgactggatccgccaagacttggtggagggatttctgtatatctaggccagcagggtctccagctttgacatgggatcagttcgcagagttgtttctggggaagtttctccccgttactcagagagatgcccttcgccgtcagtttgagcagcttcatcagggtcatatgactgtcacgcagtatgagacgcggtttattgatctggctcgtcatgctactgctatactttctacggacagcgagagagttaggaggtttgttgatggattgatccagcctattcaggtgcagatggacctgagtgccgatagtggtttatcattccaggatgcggcgaatggtgctcgccgtattgagatggcacttgctttgggtggtggtcaggggtctgacaagaggcctcgtcattccggccgcttcagtggtacctcatctgggggtagagattcttatggtagaggccagccccctaggccttatcagtcagcacttcaggcctcttatggtgctccaggcagcagcagttctcagcagtattattccggtcagcagcctttcagtgcatcaccagctcccattagtgccccgccacttcagagtttcaggggaggacatacaggtcgaccggttcagcagtcgagggcttgtcatggatgtggtgatcctggacatatcatcaggttctgtcctcatgttccgagtagatcgcagcagcagcagggacctcgtcctatgattcaggctcctgccccacagtctgcccagccagctagaggcgggggcagaggtcatagaggtggaggcagaggccatagaggtggagctcagggagctcgaggcagaggtcaggtagcagcggatcttcctagggatactgtgcagggaggtggggctcagccccgttgttatgccctaccagccagaccagcggctgagtcgtccgatgcagtgatcacaggtactattctggtttgtgatagagatgcttctgtattatttgatcctggatccacgtattcctatgtgtcatcatattttgcgccttgtgcggttatgcctagtgaggccttgagtattcctgtctatgtgtccactccagtgggagattctatagtagtggaccgggttcatcgctcgtgtgttgtggtattcaggggtcttgagacccgtgttgacttattgttgctggatatggtggattttgacgttattcttgggatggattggttatctccttatcatgcgatcttggattgtcatgccaagaccgtgaccttggcgttgccgggtatgccccgattagagtggagagggacccccggtcgtaccactcgtagtgttatttcttatatgaaggctcgacgtatggtcgagaaggggtgcttagcttatctggcttatgttcgcgattccagcgctgaggtcccgtctatatattctgtccccattgttcgggagttccccgaggtgttcccttctgatttgccgggcatgccgcccgacagggacattgatttctgtattgatctggcgccgggcactcagcccatttctatccctccttatcgcatggcgccgccagagttgaaggaattgaaagaccagcttcaggatttgcttgagaagggtttcattagacctagcgtgttgccttggggtgctccagtcctttttgtgaagaagaaagacggttctatgaggatgtgtattgattaccggcagctgaataaggaaacgatcaagaacaagtatccactgccgaggattgatgatttatttgatcagcttcagggttcgaaggtgttctccaagattgatttgagatccggttatcttcagttgaggattagggcgtctgatgtccctaagactgcttttcgtactcgctatggccactacgagttcctggttatgtcatttgggctgactaatgccccagctgcgtttatggagttgatgaacagagtatttaggcctttcttggacttatttgtgatagtcttcattgatgacattcttatatactcccgcagtcaggaggagcacgagcagcacctcagagtggttcttcagactctgaaggatagtcagttgtatgccaaggtttctaagtgcgagttttggttgagttcagtggcattcttgggtcatgttgtttcagcagagggtattcaggtagacccgaagaagatagaggcagtcaagaactggcctcgaccagcttcagctacagagattcggagcttcctgggtttagccggttattacagacggttcgtagaggggttttcgtccattgcatcccctatgaccaggttgacccagaagggtgccttattctggtggtctgacgagtgtgaggcaagctttcagaagctcaagacagcattgaccacggcaccggtgttggtattgcctacaggttcaggaccgtacacggtctattgtgatgcctctcgtgttgggcttggtgcagttttgatgcagaatggtaaggttatagcctatgcttcgaggcagctgaagatccacgagaagaactatccagttcatgatctcgagttagcagcgattgttcatgccttaaagatttggaggcattatctgtatggtgtgacgtgtgaggtctacacggatcacaagagtctccagtacttgttcaagcaaaaggagttgaatatgaggcagaggagatggttggagttattgaaggattatgatgttactattctataccatccgggtaaggccaatgtggtggccgatgcattgagcaggaagtcagctagtatgggaagccttgcttttgttccagttgggcagagatcgcttgccatagatgttcaggccttggccaatcgttttgttagattggatgtttcggagcccagcagggtattggctagtacggttgcccgctcttctctatttgagcgtattcgcgagcttcagtttcatgatcctcatttatgtgtcctgagagacacggttcagcgaggaggtgctaagaaagtgactttgggagatgacggtgtgttgagattgcaggggcgagtttgcgtgcccaatgttgatggcattcgggatttgatcttagcggaggcccacagttctcggtattctattcacccgagcgccgcgaagatgtatcaggacttgagacagcattattggtggcgtaggatgaagagggatatagttgcttatgttgctcggtgtttgaactgtcagcaggtgaagtgcgagcatcagagacctggtggtctatttcagaggattgagcttcccaagtggaagtgggagaggatcactatggattttgttactggcctcccgatgactcggaggcaatgtgattcagtttgggtgattgtggataggctgactaagtcagcgcacttcattccagttgctaccacctattcgtcccagagattggctgagatttacatcagggagatagttcgtcttcatggagtgcccgtatccattatttcggaccgaggcccgcagtttacttcacgtttctggacagccttgcatggagagttgggtactcgggttcagatgagcacaacatttcacccacagacggacggacagtccgagcggacgattcagattcttgaggatatgcttcgagcctgtgtcatcgactttggaggctcgtgggaccagtttttgcctttagcagagtttgcctacaacaacagttatcagtccagcattcagatggccccttatgaggcgttgtatggtaggcggtgcaggtccccagtcggttggtttgagccgggagaggctcggttattgggtgttgatatggttcaggaggccttggataaggtcaagattattcaggacatgcttcgcacagctcagtctaggcagaagagttatgcagaccgcaaggtcagagatgttgctttcatggttggagagcgagtattgctccgtgtgtcgcctatgaagggcgtgatgagattcggaaagaagggcaagctcagccctagattcattggtccatttgagattctagagcgagtgggagaggtggcctatagacttgctttgtcacctagtttatcagctgttcatccagttttccatgtatccatgctccggaagtatcacggcgatccctcgcatgtattagatttcagcactgtccagttggacaaggatctgtcttatgaggaggagccggtagctattctagaccggcaggttcgacagttgaggtcgaggagtttcccttcagtgcgtgttcagtggagaggtcagcctcctgaggcttcgacctgggagtccgagtccgatatgcgtagccgttatccccatctgtttcccgactcaggtacttctttcttttgtccgttcgaggacgaacggtggttttagaggtggagattgtgacgacccaatggggtcatcaccataaatgctccttgttccgtgcttctgaggccgcgaaaacctcttgagaggttgcctcgatatgcgtgcgcaattcgggcgcgaagccggaaagattttctgtgatgaaatatgaactctgtgtttaaaatggtgaaatttaagtataatattgctatagttgactccggtcaacattttgggcaaacgggttcggacccgtgtcgtatcaatttctaaatatccgtcattaaatttgggactcgtgcatatgcccggaatcgaattccgaggtcccaggcccaagatacggaattttctgtgaaaatagtttctgaaaatatcttaagactttgaaaatgaattattgcttttaaactatcgtatcgggctcgtattttggttccgatgcccggtacaggtcttatatggcgtttaagcgctttctgtaaaatttcatgtgatttggacgtcgttagacgtgattcggacttggaaatggaattcttgagttttaagtgttaagaagtgaaattgtgattttgaggcttaatcctatgttaatgatgttgttttggcgatttgatcgcacgagtaagtccgtagggtgtttttgaggttgggtgcatgtttggtttggagccccgggggctcgggtgagtttcggataggtgttagggtcatatttctgcatttttacatctggtgtctgcagtcttcgcaaatgcgaagtaatcctcgcatttgcgagtccctccctttgcctgcctcttcgcaaatgcgaagtccatcccgcatttgcgaacaccctcagttttggccagacttcgcaattgcgatatctatctcgcatttgcgagttttccccctgatcctcagacatcgcatttgcgatgtcaatcccgcatttgcgagcttcttcagtcctgtagcctgttcgcatttgcgagttttatctcgcaaatgcgaggtttccctctctgaccctccagttcgcaattgcgaactcaatctcgcaattgcgagatctgcacctgttatatctgcacttagacgaattttgaacctcatttcataacatttcaaaacccaaaactccttaggcgattttcctcccaacctctcttcatcaaatcgttggtaagtccaattttactcaacttcttcgatcatcatcatcatctaacatgatttcttcatcaatcaaagcttttcatgggtcaaaaatggtggaattagtagaacctagggttttcatattttgagcttttggacctcgatttgaggtccgatttcaattccaatcatagttatggattcatgggggaatgggtaacttagttttggtccgaacctcgagtttcgaccacgtgggcccaggggtattttggaaaattttgggtaaaactttgggaaactcatccttatgcattcaaactagtttaattagcatttattaattcatttgggtaatttatgactagatatcgttgtttgggagttggattccaaagggaaggcggtggtagagctttgaattgctaagtcggcattgaggtaagtgtttgttctaactctagttcgagggattaggattaggaagttatttgctatgtgttatatgggtcggtgtataggtttggtgacggttacctatgcacccgagtcaaaaacatgaccgtgagtctttatttaagattgtcgaaagctatgttatggaatttagctattgaattgatacttgtgaatgacttgtgggaatcatatgacctaaatggcttaattgaaaggttgaatgaaaaatcatgtctacttgagttgaatgcgaaataatctctatataccttgccgggttggataagtatatgtgaattgtttgtgttttccccgtaatgggtcttatgtgaacttgaaatgagggcgggtggtacgcctaccacaagacacattgaaatgagggcgggtggtacgcctaccacaagacacattgaaataagggcgggtggtacgcctaccacaagacacattgaaatgagggcgggtggtacgcctaccacaagacatattgaaatgagggcgggtggtacgcctaccacgagatgtgatttaaatgagggcgggtggtacgcctaccacgggatatactgaagtccacttgtacttgatatgtgtttctttgtcggttattgattatttgtttagctagtcgcattttcatttatttgaactgtttcccccttatatagcatgtcccctcccatacttggttaattcatgcattatttttctgtttcgcacatatatatatatctgtacaggttaacgctgtaggtccggtctagcctcgtcactacctcgtggaccggggttaggccaggcacttaccagcacatggggtcggttgtgctgatgctacactttctgtgccttttgtgcacagatacgggagcagctttcggacagcagtgccagcagtagatcgggagcgcgccttcagtccagagactattaggtagctcactggcgtccgtgggtccttagtctcttccgtctttgttatttagtccattgtattcggacaagcatttcatgacatttctttctttgagtcgttatttgtagtaactcctagtacgtctgtggatactgtgacactaagttctgggtagaagtcagtagttgaatctttattccgcattcgggttatgttatattctatatatgttgttacttccgcacttgatcttccgctttaatttcatattgttaaattgttaagttattgttatttcgttaagtggcttgcctagctccctcagtaggcgccatcacgaccccccgacggtgggaattccgggtcgtgataatatttgtgtatatattgtatatttatactatagtatatattgcaagttattatttattgtaatatattctaagtatatattatatatttatattgtagtatatattgcaagtaaatatatattatagtatacttgtagtatacttgtagtatatttgtagtatatattgtatatttatactatagtatatattgcaaaaagatattcaagggcaagtgttatcaaattttattataaaaatagcatatctttcttagtcttcctccccccaatggaatgagcacaacaaggtactaataccaccattaaagaaaaaaaaactaaaagaagatgtgccaaaatacaaattacatagactctatgtattatctctaacatatttcataaatccttcaaggtttggtggaggttgcgttggtggtggtggaaaagtagcttgttcatcaccacttccgggcgaagaagcatcttgttcaagttccgcaagcatttcttcataacattcatctagcaaaggttgtgattccgcaactccaaagtttcttctttccgagcggatccaatctctgaatagtactgatttttccaagctgtcccgcattgacgctctatgatcacctatttgaagccttgcttgactgaaagcgctctccgatgcaacagttgaagcttgaattgataaaatatcccgagccatccttgcaagaaccggaaaatgtttttcccttatcttccaccattccaaaagatcaaaagagccgtccgaattctcctgttcaagtccttgcgacatataaacttgaagctcatttagttgtgaactttcattaatattttcaccttgagaacccctgaactcctgccaagatttaagagcttttaagcccgcaggtcttttggatgattgtgaactagatgaagtaggggttggaatatttggcctagcatgatctaaggccgcttggtaagcattataaatcaattgagcatcaattaaaattgaggcttttgcctgtccaagtgtagcactttcctcatttgaaagatctaaggcactataaatctgtgtgtaccaaaaatgaggacctcccaacttcattgtaggatttaacaatgcagcaacaccaaaaataggagggattgggaaaaaatattttttaaacttttttttcattgcagcaatagccatttcataaattaccccaccctccgcaaagtcattaaacaattgggataatgttgaaatataaactaaacagttggaaatagtaggataatattgcccagaaaacatatttgtagcagcataaaaatgttctaaaaaatctaaaagaattttaacacttgcccaatcttgcgtagtaagaatttcatcatcttcctcaccagctacccgagcattgaacgttgcattaattgggtttctatattcatatgcaactactaaactttcgtacataccattccatctagtcgggcaagctttaggaacctttctttctttaaggccatattcatcacattttttataataatctctaagtctacttctacggtttgaataaaaaagccaattaagtgccattctaaccttttcaatttccatgtttaaatgtttcattccagcaccgacaattaaatgataaatatgacacatacatctaacatggaaaatattactaaatgcaggatttagttttgttagaagtaatcctatagcattagtgttactagaagcattatccatagaaattgacattatttgatcgctaaagcaaaaatatctacaaacatctgcaacagtcttagctataaacttacctgtgtggcatgaattaattattctgtacgcaataatgcgtttttgcattgatcattcctcatctatccaatgacttgtaacgattagataatcaagatcattaccacttctaccaatatcagtagtaatagaaatacgattaggtatatgagtaaataaataccgcaaatattgctcatattcatgtttatatttataaatatcggccttaactgttgcccgaggccaacctttgtaagtaggattaaaaattcttctaatatatttaatccaatgtggattagaagaaaaggaatatggtaagcacataacagtaatcatcttggctaattcttcacgatctttaattggatcgtaatataaaatacctccggtcacagtattaattccaggttgaactaaatttgaacctgtactaggattaacagcagtatctacacttgtaccctctaattgtgctttcattcgatcaaatctaattctatcattaacatgagttcttatgtgcctagtcaaagtacccgtgccgctacagtttcctttatatttgtgtactaattttttaccacaggttttacacttagccttattttcttctcttaattgagtaaaaaaactccaaactaatgatgtttcttggcgtttagcaggtcccctagtaaaagtaggggtttctacaggtgggtcggccggttcatcatttgggttattaacaggactagtaggcgtatcatctaaatccggtggttgagtttcatcttcatcctcattttcctcatcattttcaaaaatagtttcattaggataaagagcattcatagtttcagtatctaaagtttgacctggtataacattatggcaaaattgagtatcggaaaattgcatacaagggtcttcactatcaagaataataggggcagtaggacgtctacgttggcgactactactttcaacttgcttatcttttctaggtcggggagccggggggaggggaggagttggttggttactactttcaccttgcttagattttcccttaccaaatatatttgttaaatatgccatactaattataattacgcaaactaaaacacacaaaaatatattctaaaaacgtaagagttgaaacgagtttaccggattgccgaaaaacttcttcaaaattgaaagttgtttaacacttgaacacttgaaaacttcaattcaacaacttcacaatttttttccgaattttcaacaataaattaagcaattgtagtagagagattgagagagattgagagagattgagagatattgatgaattggtgaattaaaatgaaagaatgagggggtatttatagttgagaaatgggtaaaagtgtaattatttaaagtttgaggttatattaaagtttgggggccaaaatgtaaattttgaaacccccaaacggtcaaaaaacggccataaacggctagtttttaaacttgaccgttgggggctttttttttaaaaaattttttttttttttgaaaaatggccgttgggcccgccaggcccgcgaggaccgccaggaccggaccaggaccggctgacggtcccgggcctcacggtcccggtctcgtgggcttaaaattcaagaccagcccgtgacaggctttattgcactacaggcccaggaccacttggaccggcccacaaggcccgtgaggcccgcgaagaccgtgagaccgtaacggtcccggtccgggaccggcccaccatacaacattatttgcaatctttctgattacggaaaaggtccaaatatgcccttaaactatccgaaaaaggacatatatgccattcgttattagttcggcccaaatatacccttttcgtccaatagttggccaaatatgccctttatttaacggaaatcgttaattaatatcaaaatattttttttcagttcttaattatttttaaacaaaataattatttttgtaaaactaaaaaataattgaaaaactgaaaaaaaataaatattttctttttatcagtttttagttttaaaagaatccagttttacaaaaattattattttttagattttacaaaaatcattattttagaaaaaaaaaattgcttttttaaagcaattttgtttttcgtttttttagtttttaaaaaaaataaattcagtttatttttagttttacaaaatattgctttagaaaattgctttttaaattttaattctatttttacaaaaatattgttttaaaaaataatttttcagttttttttaaagcaattttttttcttcaatttttagtaaaaataaattcagtttttttttttttcagtttttacaaaatcattgctttagaatattgctttttagattttatttttgtttttacaaaaatattgttttagaaaataatttttcagtttttttaagcaatttttcttcttcaatttttagtaaaaataaattcaattttttttttttagtttttacaaaatcattgctttagaaaattgctttttagatttatttctgtttttacaaaaatattgttttagaaaatatgttttagacaaaattgctttaaaaaaagcagttttttttttctaaaacaatgatttttgtaaaatctagaaaaaaataatttttgtgaaactggatttttttaaaactaaaaactgataaaaagaaaatatttattttttcagtttttcaatttttttttagttttacaaaaacaattattttgtttaaaaataattaagaactgaaaaaaaaaatattttgatattaattaacgatttccgttaaataaagggcatatttggccaactattggacggaaagggcatatttgggccgaactaataacgaagggcatatgtgtcctatttcggatagttcaagggcatatttggaccttttccgttctgattattttgatttgaaaattattttagcatttgttgattttggtctgttaataattattttatttttttaatggatattatagtagggttgggttcatgttgatttttattttacctaaacctgtcgaatattgaagtgtagctgtttacagcagagtttaaacacaattcattactgctaaaatattggcatataagagtttttgatctaaatatttgttgaatatttacccttttcaaatgaaagccaaggtttaggtgggactcatttggtcatctttttgcaatattggtaacgttgtcttccgccaactgcgcttgtactctatcaaggtaattacatgggtttaaaagtttttccgctgtattttgtgtctgttactaaaataaaagcaggccttaatctctttgtgtactaaaaataagtgaactcaaacgtaatcttcttcccattaaaaccaatagaaaaacggaggacactatgtaaactcaaaattatatcaatatcaacttcaatgtaactgttaacaaaaagaccctttgggtagtgagaaaaataaattttaggtgatggatttaggaagtgaaagtaggagagaaggaagtttttttgaaaaatgaaaatttactactttgtagcaaagaagcacttaggaacacaaagcctttggctaaggaactcttttttgggagaaatagaaattttactactttgtagtaaagagaatacttaagcttttagcttaggaaatattacaactctttgagttttctctacactttccactaaggggctaaacccctatttatagtagtggtaggaagtttctacacatattctacattaatctactacacactaaatatctagatatttctatacattattaatattttattctaatatctagatttttcttctaaaatatctagatattttgttagaagattctattatatctagatacttctaattagtggacttgggcttatttcatctttcaactaatgatccaattaataaagtggatagtcctatattattaattggatcaaatcaagtttatttactaacaccctcctttaaacttgatttgccgactccaagcatcatccttagtctcgcaaagtcttctcctttaagtggcttagtgaagatatctgcaacttgatctcgagatctcgtatgcttcaactccacgatcttgtttgccacacactctctgatgaagtggtatcttgtatcaatatgcttgcttcgatcatgatagactggattctttgctagatcgatagctgacttattatccacataaatctctgtcgcttcttcttgtggcatattcaactccttcatcatgtttctgagccaaattgcatgacatacacaagagactgcagccacgtactcagcttcacatgaggacaaagtgactataggttgcttctttgaaacccaagtaaaagcagtgttaccaagaaagaatgtgaatccagtagtccttcttcgatcacttaagtctctagcccagtcgctatcactgaatcccacgagcttgaagtcttcagatgaagaatataacaaaccaaaatcaatagtacctttgatgtagcgaagtattctcctggaactcttcaagtgtattgtagttggcgattccataaatcgactaataagccccacagcgaagagaatatcaggccttgtgcaagttaaatagcgcaaacttccaacaaggctcttaaaataagttggatccactacttctccttcattatcctttgagagctttgctccatattcaatgggagtacgtattggcttgcacttctccattccaaatctcttgagtacctctttagcatatccttcttgagagatgaatattccatcttccatttgcttaacttcgatgccaagataataagacataagtcctatgtcactcatctcgaattcatgagtcatagcctccttaaactcttcaatcatgcttagagaatttcccgtgaagatgagatcatccacgtacaaacaaacaagcaatatacctccattgcttgaaaacttcacataaagtgcatgttcactcgggcatttcttaaaaccatttttctgaaagtagtggtcaattctagtattccaggctcttggtgcttgtttcaagccatatagagcctttttcaacttaagaactttattttcatgtcctttgaccacgtacccttctggttgctctacatatatttcttcttcaagataatcattcaaaaatgcatacttgacatccatttgatggattttccatctattttgagcagcgatagagattactaaccttatagtctccaagcgagcaactggagcaaatacctcgtcatagtccacaccatgcctctgcttgtagcctttggcaacaagtcttgctttgtacttctctacttctcctttagcattcttctttgccttgaacacccacttgactccaattgctttgtggccttttggaagagaggctaactcccaagtttgattcttctctatggagtttatttcctcatccatggctttcctccatttctcattctgagctgcctcttcgaaacctagaggttcacagtcagcatagagacagaaaagtgtgagagcctctatacgttctgtttcctcatagatctcttgtagacttctcgtatgttctgtctcttcatgtggactttgaggttgctgagtgttttcacccgcatcatcatattcttcttcatattcaggaatgatagggagaaagtcttaactatcattgccttcagcattccattcccacattccttcgtcgtcatactccacatctctactcacaaccaccttcttcgtgattggattgtagagcatgtagccttttgattgcttgtcatagccaacaaatacattcttctcactttgatcatcgagctttgcccgcttctgtcttgatacgtggacatattctatgcttccaaacactcgtaggtgacttactgtgggttttgccccgttccatgcttcttgtggagtcttgtcttgtagacttttcgtgggacatcgatttaggaggtacacagcacaatcaacggcttcagcccaaaattcctttggcatcttcttactttttagcatactacgaaccatattgagaatggtcctattctttctttcagcaacaccattttgttgcggagagtaaggagctgtaaggaatctcctaatcccattttcttcacaaaatttggtaaattctcttgatgtgaattctcctcctctgtcagacctcaaggctttaattttcaagcctttttctttctctaccaaagccttaaatgtcttaaaggcatcaaaggcttgtgatttctccttcaagaaatatacccaggtctttctagagaaatcatcaataaataggatgaagtaattattcttaccatgggacgacggagagattggtccacacaagtctgtatgaatgagttgtaaaggctccttagctcttgatgttgcctcttttgggaaagcactccttgaatgcttcccaagtagacatccttcacaaacttgatcgggctgattgataggaggcaatcctttcaccatgcattttgcagacaataacttcaagtcaccaaaatttaaatgaccatacctcgtgtgccagatccacgagtcatccttcaagcatgctttcatgcagttttcatgttgaatattcaacaagaacattctattgtttgtcattggcacaatggtgatcaactttccttctgcatccttaattatagcactacgatttttcaaatgaatatcgtagtttttctctagaagttgtcccagactcaagatattacttttaagacttagtacatagtaaaactcagagatgtattgatgacttccatctttagcaaggattagtatcttacctttgccttcaacccttgctctagagttgtctccgaaaacaacgtagcctttggcttctttcatctccacgaacaactttctttctccagtcatgtggttgctcgcagcggagtcaagataccaagttttcttccctccttcgtcctcgtgtctcgtcattagaagagtgagttcaacttcatctttaacctcaacataattggccttttcttctacatggctagaacttctacactcatttgcataatgaccatactttttgcaattaaagcattggattcgagatttacctcctctttgaggattcgtacttcttccacggcctctcatagattgagatccttggttggtatcctcgttcgtggcttgtatgtgtccacctcgagctcttcctcggctacgtcctcgaaatccaccattacctcgtccttggcttctaccaggaccaaatcctccatctctttctttgaaagagagttttgtgtaaagagcttgatccaaagattctttggatctcctcttttttagtttctcttcatggactatcaaagtacccatgagttgatctacggtcatagagtctggatcattcgattcctctatggccaccacaatataatcaaagtttggtgtcaaagagcgaagaattttttctatcactcttgtgtcacccaaactttctccattcctcttcatttcattagagactttcaagacacgagaacaatagtccgagacagattctgattcctccatttgcaatgcttcaaattctcctctaagagtttgaagacgtaactttttcaccttctcgattcctctatgggcattctcaagaatctcccatgcctccttcgatgtagtagcatttgccaccttctcgaacatagattcatctaagtattgatggataagtgagaaagcatgttgatccttcctcttcaacttcttgagttctcccttttgggcagcacttaaagtaccctcatcttgaggtttctcataacgcttctcaacaatctcccacacctcatgagatccaaggattgctttcatacgaatgctccacttaccatagttttctttggtaagttgagggaattgaaatggaatcatgccactagccatttaggtttcaagctggatcaacaccagctctgataccagattgttaacaaaaggaccctttgggtagtgagaaaaataaattttaggtgatggatctaggaagtgaaagtaggagagaaggaagtttttttgaaaaataaaaatttactactttgtagcaaagaagcacttaggaacacaaagcctttggctaaggaactcttttttgggagaaatagaaattttactactttgtagtaaagagaatacttaagcttttagcttaggaaatattacaactctttgagttttctctacactttccactaaggggctaaacccctatttatagtagtggtaggaagtttctacacacattccacattaatctactacacactaaatatctagatatttctatacattattaatattttattctaatatctagatttttcttctaaaatatctagatattttgttagaagattctattatatctagatacttctaattagtggacttgggcttatttcatctttcaactaatgatccaattaataaagtggatagtccaatattattaattggattaaatcaagtttatttactaacagaaacgacccgttcttttattttgagagttataacttcgttttccccatctatcattctttatatattattcagctatattgagttgtattgagttggtaggtttgggttcagagtagttttggagtgaaatgaatacttagtcttttagttagaaagctaagttagaaaagtcaatcggaggttgacttatgagtaaacgaatttggatttggatttttatggtttgtttagcttcgttaggtgattttagacttaggagtatgtccagaatgtaatttggaggtctgtggtagaattaggcgtgaattggcaaaagttggaagcttagaagttcttaggcttgaattcgaggttgattgggtcttttggtgttgttttgggtgttccggaggttcgactaagttcaagtcgtgatatatgacttgttggaatcattggttgaggttccgagagcctcgggtgagtttcggataggtttggattgtgttgcgctcgtttttcttatgtttcgataccgtttcttcatgtataaatgatatcatattgaacaaatgagctgagatttctattttgattgaagaattagttccgtattgtaattacggacccgtagcaaaaagaatcgtcgaatttggatattgtatgaggattttaggttgattttactaagaattaggttaccagatttttcagtttaattatgaaattgccactagcagcgtatttaaaaatctgcactatttgcaaatattaaaacctatatatgtcattcattataaggtcaaattgagtgattcaaaagcctaacttgactagaatttcacaaggaatctattggagtcataaaacacgagtttcgagattgtttgacacaagaaacgaggcagaataactggcagaaaattttataaaactagggtttgttcattcgatcatattttgagttggggacctcggatttgggcgattttggaggcgattttcactatatgaattggggtaagtcttctctactcatttttggttatatttcatgaatccatcatcgtttttaggatttaattgatgattttaaagtgaaattgagggagttagggcttgagttttggagagttttaggtagggatttgagggaccaaacagagtccgattttgacaaattttatatggttagactcgggagagaacggggtttatgattctgccatttttgactgatttctagacgtgggctcgggggccggatttatgccgatttcggataattggtatattttgtagtttttattgtggaattcgattctttagcacatgttaatgatattaatctgattatggttagattcggaagttttggagacagagtccagagaagagggtatcctgaagtaggattttatgttgttgaggtaaataaaatttttcactctagctttgagggtataaacccggagaatttgatataatgtgattggttggaggtgatacccacactaggtgacatgcgtgtgggtgtatacctcgtgggattaagactcggtccgtcccgtgagatgcgagccctaatagctattatctgtggttatgtgtttacttgttgttgaacttgtctaccttcatgttagagatcatacttaggctttattcatgcttacattatttttactcactcatgtttcctcagtctgtaatattgctaatatgccgtgatacttgatgtggtttgtgttcccttatttgttgatgatggtgaggctagtgaggtacatgattgagtaaggccaagggcctggttttgaggatattaataccatagcgcgtgagttgtccacgtagcatataagttgatcgtgcgggtccaggtattgataccatagcgcgtgagttgtccgcgtagaatgtgagttgaccgtgcggatccaggtattgatatcatggcacgtgagttgtccgtgcttagtgcttgggctttgggagcccctccggagtctgtacacaccccagtgagcgcagagtgttgagtgtattgaatgttgagtgttgagtgctgagtgattgagtgacattgctgtgaagttgtatctacttttgttgttgttgcatttatctgttaaatttctttgtggtatttactgagttatagaatttagctgtttatttttaaattgtgaaaataataattggactatttttcttagctcgtcactacagctcagttccttagttaattctgttactactgaggtggtagtactcatagtacactctgcactttatgtgcagatccaggtgagttagacgcagcgattgttgatttcaggccagctatctgtggagattgcaaggtagctgctagtgtccgcaggaccttgttactcctcttatcatttcttcttttggacagttagacagtttatatatcttagtttatagttttagacgctcatgacttagtgacaccccgatgtttgggactcatttccgtattttctatattatatttagaaatgttaatttttttaattaattttgtataatcgatttagtagtaatattttgggaagtaggcttgccttgtaacacgataggcgccatcacgaccatggttagattttgggtcgtgacaagttggtatcagagcctagattacataggtctcatgagtcatgagcgggtttagtagagtcttgtggatcggtatgaagatgtatgtacttatcatcgagagactgcagaacctttaggaaaacttcaccttcttgaattcttatcgtgcggtattgattcagcttgaagtgtaactttttgaattccttccacgcattcgtatgcgcacatgagtgctcagtatcaattgtgcatccacggattgtaatcccttgatgggtacgtgattagtatgatgtgactgctagatgtgttcatatgatttgaatgtgacgagaaggtattgctgaatgtttcacctatttgagactctagttatatatttatactcgttcgaggacgaacgtttgtttaagagggggaggatgtaacgacttgttctttcattttgagagttataacttcgtttcccccatctatccttctttatgtattattcagctatattgagttgtattgagttggtaggtttgggttcagagtagttttggagtgaaatgaatacttagtcttttagttagaaagctaagttagaaaagtcaatcggaagttgacttatgagtaaacgaatttggatttggatttttatggttcgattagcttcgttaggtgattttagacttagtagtatgtccagaatgtaatttggaggtccgtggtagaattaggcgtgaattggcaaaagttggaagtttagaagttcttaggcttgaattcgaggttgatttggtcttttggtgttgttttgggtgtttcggaggttcgactaagttcaagtcgtgatatatgacttgttggaatcattggttgaggttccgagagcctcgggtgagttttggataggtttggattgttttgcgctcgtttttcttatgtttctataccgtttcttcaagtataaatgatatcatattgaacaagtgagccgagatttatattttgattgaagaattagatccgtatggtaattacggacccgtagcaaaaagaatcgtcgaatttggacattgtatgaggactttaggttgattttactaagaattaggttaccagatttttcagtttaattatgaaattgccactagcagcgtatttaaaaatctgcactatttgcaaatattaaaacctacatatgtcattcattataaggtcaaattgagtgattcaaaagcctaacttgactagaatttcacaaggaatctattggagtcataaaacacgagtttcgagattgtttgacacaagaaacgaggcagaataactggcagaaaattttataaaattagggtttgttcattcgatcatattttgagttggggacctcggatttgggcgattttggaggcgattttcactatatgaattggggtaagtcttctctactcatttttggttatatttcatgaatccatcatcgtttttaggatttaattgatgattttaaagtgaaattgagggagttagggcttgagttttggagagttttaggtagggatttgagggaccaaacggagtccgattttgacaaattttatatggttagactcgggagagaacggggtttatgattctgccatttttcactaattttgagacatgggctcgggggccggattttggtcgattttggatttttggtatattttgtagtttttattgtggaattcgattctttagcacatgttgatgatattaatctgattatggtgagattcggaacttttggagatcgagtccagagaagagggtatcctgaagtaggattttacgtagttgaggtaagtaacagttttcactctggctttgagggtataaacctagagaatttgatataatgtgattgtttggaggtgatacccacgctaggtgacgggcatgtgggtgtatacctcgagggattaagactcggtccgtcccgtgagatgcgaggcctaatagctgttatctgtggttatgtgtttacttgttgttgaacttgactaccttcatgttagagatcatacttaggctttatttatgcttacattatttttactcactcatgtttcctcagtctgtaatattggtaatatgccgtgatacttgatgtgggttgtgttcccttatttgttgatgatggtgaggctagtgaggtacatgattgagtaaggccaagggcctggttgtgaggatattaataccatagcgtgtgagttgtccgcgtagcatgtgagttgaccgtgcgggtccaggtattgataccatagcgcgtgagttgtccgcgtagcatgtgagttgaccgtgcggatctaggtattgatataatggcacgtaagttgtccgtgcttagcgcttgggctttgggagcccctccggagtctgtacacacccccagtgagcgcagagtgttgagtgtattgaatgttgagtgttgagtgctgagtgattgagtgacattgctgtaaagttgcatctacttttgttgttgttgcatttatctattaaatttctttgtggtatttactgagttatagaatttacctatttatttttaaattgtaaaaataataattggactatttttcttagctcgtcgctacagctcagttcttagttaattatgttactactgaggtggtcgtactcatagtacaccctacactttatgtgcagatccaggtgagttagacgcggcgattgttgatttcaggccagctatctgtgaagattgcaaggtagctgctagtgtccgcaggaccttgttactcctcttatcatttcttcttttggacagttagacagtttatatatcttagtttatagttttagacgcttatgacttagtgacaccccgatgtttgggactcgtttccgtattttctatattatatttagagttgatttagtttatgaaaaacttaaatgttaatttttttattaatttgttataatcggtttagtagtaatattttgggaagtagacttgccttgtaacacgataggcgctatcacgaccatggttagattttgggtcgtgacaagttggtatcagagcctagattacataggtctcacgagtcatgagcgggtttagtagagtcttgtggatcggtacgaagacgtctgtacttatcttcgagagactgcagaacctttaggaaaacttcaccttcttgaattcttatcgtgcggtattgattcagcttgaagtgtaactttttgaattcctttcacgcattcgtatgcgcacatgagtgctcagtatcaattgtacatcgatggattgtgattcccttgatgggtacgttattagtatgatgtgaccgcgagatgagttcatatgatttgaatgtgacgagaaggtattgctgaatgtttcacctatttgagactctagttatatttttataatcgttcgaggacgaacgtttgtttaagagggggaggatgtaacgacccgttctttcattttgagagttataacttcgtttcccccatctatccttctttatgtattattcagctatattaagttgtattgagttggtaggtttgggttcggagtagttttggagtgaaatgaatacttagtcttttagttagaaagctaagttagaaaagtcaatcggaagttgacttatgagtaaacgaatttggatttggatttttatggttcgattagcttcgttaggtgattttagacttaggagtatgtccagaatgtaatttggagatccgtggtagaattaggcttgaattggcaaaagttggaagtttagaagttcttaggcttgaattcgagcttgatttggcttttggtgttgttttaagtgttccggaggttcgactatgttcaagtcgtgatatatgacttgttggaatcattggttgaggttctgagagcctcgggtgaggttcggataggtttggattgtgttgcgctcgtttttcttatgtttcgatatcgtttcttcaagtataaatgatatcatattgaacaaatgagctgagatttctattttgattggagaattagatccgtattgtaattacggacccgtagcaaaaagaatcgtcaaatttggacattgtatgaaggttttaggttgcttttactaagaactgggttacgagattgttcagtttaattacgaaattgccactagcagcgtatttaaaaatctgcactatttgcaaatattaaaacctacatatctcattcattataaggtcaaattgagtgattcaaaagcctaacttgactagaatttcacaaggaatctattggagtcattaaacacgagtttagagattgtttgacatgagaaacgaggcagaatatatggatgaaaattttataaaactagggtttgttcattcaatcatattttgagttggggacctcggatttgggcgattttggaggcgatttttaccatatgaattggggtaagtgttctctactcatttttggttatattttatgaatccatcatcatttttaggatttaattgatgattttaaagtgaaattgagggagttagggcttgagttttggagagtttgaggtaaggatttgagggactagacggagtccgattttgataaattgtatatggttagactcgggagagaacaaggtttatgattctaccatttttgactgatttcgagacgtgggctcgggggccaaattttggccgatttcggatttttagtatattttgtagtttttattgtggaattagattctttagcacatgttgatgatattaatctgattatggttatattcggaacttttggagaccgagtccagagaagagcgtatcctgaagtaggattttacattgttgaggtaagtaacagttttcactctggctttgagggtataaacccggagaatttgatataatgtgattgtttggaggtgatacctacgctaggtgacagacgtgtgggtgtatatctcgagggattaatgtaacgacccgaccggtcgtttttagaatttgcaccccgttcccccgttaactgcttcccctaagtttatttaagctattttgatttgccgggaggttcggtatttgaatccggagtgtttttggacaaatagtcctttattgagagtcttagtgatggaaagtggtccgttgtcggacattatcaagacgacctcggaatggaaattcgatggtttcgttagctctgttaggtgatttcggggttgggagcgtggccggattgtattttggatgtccgtagctcaattagcctagaaatgccgaaagttagaaatttggaatatccggtccgatagtgaatttttgatctgagagtcggaacggagttccggaagttgctgtagcaccgtcacgtcatttgggacgtgcgtgcaaaatttcaggtcattcggacgtcgttaggataggtttttgatcaaaaatgattttggttaagttctggaaattctaagttgaaatcaatgagtgattcgtgtttccggtgttgttttaggtggtttgaggattggtacatgtccaaatgatgttatgggttatgattgtaggtttggttgaggtcctgggggcctcgggtgtgtttcggatgttcaacggattagattaggaagtagaagggaaaaattattgcagaccttctgctatttccgcttacgcggaaaaggagccgcacaagcgaggtccgcttaagaggaaagtgggtcgcagaagcggacgttaccgcataaacggctggtcggtcgcacaggcggagactgcttaagcggtcagttagccgcacaagcggccgctggacttttaatgagaaaccgtagaagcggatttttgaaccgcacaagcgggaccgcgtaagtggtcaggaacccgcttaagcagaaatcacagaagaaatgggtttaatccgagggtttgatctcataagttaaaagaccaattcttagctcggaccaaggcaatttttggtggatttcaaagaggagattattgggtaacgtttctatgatcatttctacctttaatctatcatctagttgcttaatccatcttttaaattcaaattgaggtccaaaaatggaggaaatgggttaaagttcctagtctaatcaattgggtttttgagtgagtatttgacctccggtttgggagaattttatatggttagactcgtgagagtgcgaggtttctgaaagtgtaaaaatattctgattccgagatgttggcctgaggggcattttagttatttacctattttcgcgccgtagcttcaattttattagtgtaattagttaattgcgttgttatttatactttgtaactggtttgaatagattcgggccattcggagttggatactcgtggcaagggctttgcttcatattgattttggtaccggttcgaggtaagtggcttgtctaaccttgtgtgggggacttctccccttaggatatcttatttgctattttaaatgccttgtgcgcgaggtgacaggcgtgtacttgagctagttgttagaatttcactttacttgggatacttagtctgtacctattcgattattagactgttagatactagttacctgtgttaatctaggaaaagcatgttagttgatttaactgccctatttgacttagttgcaatacttgtttttctgtgaagcatgtctcacttagtattttccttgggtttgtactactgcgatgtaattatgagtttttcctatactttggatattctgagactggccgtgtggatactaagagatccctggcacgtgagtgattataattgagggtaccaggagatcctcgggatactggagatccgttgtgaatatttgaggataccgggagatcctcgggataccatgagatccccgatgactgcttgtttgtattaatcgtttcgttcatagattgtttttattcgaattgttacattgcttattatcctgttagtctcttaaattgctttatttctccttatttatattactgcttcatttatattatctcagtagggcctcgaccttcctcgtcactacccaaccgaggttaggcttggcacttactgtgtaccgttgtggtgtactcatgctactcttttgcccacttctgttgtgcatatccaggtacttccggcacggcgtttcagcagtgagtccggagcagctatttaggagacttgaggtatacatctgccgcgtccgcagatcctacgagtcctcgttctatcctactcgtatctttgatagtagttgttctgttatcccttgtattagacttctggatgtttagatcttgttatattcagaattcttagcctgtgttgcccgtgagttttcgggttttggggatgatttcaggggaattataaatgctaagtgtatgtgccgggcggcacttattacatttcttatattattttagttcttattgtcttatcttatgagaatgttatattccgcaatgagttaggcttacctggccttaccggtcaggtgccatcatgacaatgttcacggtcggtgaactggggttgtgacaagttggtatcagagctctaggttcataggagtcacgggacacaggccggttgtttagagtctcgctgatcggtacgaagacgtctgtacttatctacgaggggctatgtaattgtttaggaaaatcttcacttcttttgaattccttgtcgtgcgacattttggacaccaaatctaacttctgtctttctattctctcacagatggtgaggacacgcacgacccaggatgatcaggcgcccgcaccccctcctgcagtcgttagaggcaggggccggggctggggccgaggtcatcgacgcgcacgtggtgcagctagagcacctgcgcgagctgctgctgaggtaccgccagccattctagtcggggctcagacgcccgacacgcccacagccactactattccagctattcaggaggcactagcccagttcatgagtgcctatactgcattatctcatgcagggctgctaccccttcctgcagccatttctcaggccaggggaggagcacaaactcccgccgcccgcactccagagcagcgagtgcatgttgatcaggctcctggtattgttcatattcagtctaccacgccagttcagccggaggaggagatacctgcctcagaggatgagcagaggaggttagagaggtttaaaaagtatgaccctccggtattcagcggattggccacggaggatgccttggagtatttggaggattgtcaccgcattttctgcaccatgggtattactgctacgagcggggtttctttcgcttctttccagctgcggggagctatctatgattggtggcgtacctttgagctatccagtccggatcaggctgcctccctgacttgggctcagttttctgctatgtttgagagggagtttgttcctcagagtcttagggatgcttggcatgcggagtttgagcacttacgccagggtagtatgtcggtttctgagtattctatccgctacaccaggttggctaggcatgcacctgccttggttgccacagttcgtgagagggttcacaggtttattgagggccttattccccctgtcaggtccagcatggcccgagagcttgagatggatattccgtatcagcaggtggtgaacattgcttggaggattgagggtctacacgccagggagcgtgatgagagagaggccaagagggctcgagagtcgggtcgctactctagcacccgaaatccttcagcaggtcatcatggtaggggctatacaggctgcccagttcactcagctcttccttcacctagcggcacttcagctcctcccagatcttaggagccatattatgcacctccagtttctagcgcgcctcctgcgcggggtgctctcagaggacagtccagcagaggaggacagagtcagtctcagccgccgcgccctcccagagcttgctatgagtgcggggatacctgccatgttgtgagggattgcccgaggctcgggaggagtgcacctccacagcagtcccagcatcagcgtactcctcagagttctcaggctatggtcccagctccagctgtcaccccacctgcccagccgactaggggcgggggtaggggaggtagaggtcgccctcgagggggatgccaggcccgttattatgctatgcttgcccataccgaggctgttgcctccaattctgtcatcacaggtattattctggtttgcaccgagatgcatcggttctatttgatccaggctcaacttattcttatgtgtcttcttactttgctccatatttgggcgtatcccgggattctctaagttctcctatttatgtttctactcctgtgggagattctcttgttgtggaccgcgtttatcggtcgtgtttagttactatccatggttttgagaccagagctgatcttttattactccatatggtggattttgatattatcttgggcatggactggttgtcgctccattttgctattcttgattgtcacgctaagaccgtgacgctagctatgccaggtgttccacgtattaagtggagtggtactgttgatcacactcccagcagagttatctcttatcttaaggctcaacgaatggttgagaaggggtgtgccgcgtacttagcttatgtgcgtgatgttagtgttgataccccttctattaattctgtccctgtagtacgggactatcccgatgttttcccagctgatctaccgggcatgccgcccgatcgggacattgattttggtattaatttgttgccaggcaatcagcccatatctattcctcattaccgtatggctcctcctgagttgaaggagttgaaagatcagttacaggagttgcttgataagggttttattggccccgtgtttcaccgtggggtgctcctgtctcttttgtaaagaagaaggatggcactatgcgtatgtgtattgactatcatcagctgaataaggttatggtgaagaacccttatcctttgcctcgtattgatgatctatttgaccagctttaggcgcacgggtgttttctaagattgatttgcgctcagggtaccatcagttaaagattcgggagccagatatcctgaagactgccttcaggactcggtatggccactacgagtttctagttatgtcttttgggctaaccaatgccccagcagccttcatgcacttgatgcacaacgtgtttcggccatacctcgaattgtttgttattgtgttcatagatgatattcttatttactcccggagtcgggaagagcatgagcaacacccgaggacagtgcttcaggctttgagggaaaagaagttgtatgcaaaattctctaaatgtgagttttggttagattctgtggcattcttgggtcatgtggtgtcgagcgagggtattcgggttgatccgaagaaggtagaggcagttcagagttggcctagaccttcctccgcgattgagattcgcagttttcttggcttggagggttattaccgtcgatttgttgaggggttttcttttattgctacacctatgactagattgacccagaagggtgctccgttccagtggacggaagggtgcgaggcgagctttcagaagctcaagactgctttgactacaaccccagttcttattctgccgacaggttcgggttcttatactatctattgtgatgcctcgaggattggccttggagcagtattgatgcaggacggtagggtgattgcctacgcgtccagacagttgaaggtacatgagaagaattatcctgaccatgatctagagttagccgctattattcatgccttgaagatctggcgtcactatttgtatggcgtgccttgtgagatttatacggatcatcgaagcatacatcacttattcaagcaaaaggatctaaatttgcgccggaggagatggatggagttgttaaaggattatgacatcactattttgtatcacccgggcaaggccaatgtggtggccgacactttgagtctccgggcggagagtttgggtagtttggcatatctaccagcagctgagaggcctttggctatggatgttcaggcattagccagccagtttatgagattggatctttcggagccaagtcgggtctagcttgtgtggtctctcgatcctctttattcgatcgtatcagggagcggcagtatgatgacccccatttgcttgatctcaggggtagagttgagcttggcgatgccagagacgtgtctattggagaggatagggtattgaggatacggtgtaggatctgtgtacccgatattgatgatattcgagatctgatcttagcagaggctcatagctcgcggtattccatccatccgggtgccgcgaagatgtatcaggatttgagacagcattactagtggaggcagatgaagaaagacatagtggaatttgtagctagatgcctcaactgtcagcaggtgaaggctgagcatcagaggccgggtggattacttcagcaaattgagataccagagtggaaatgggagaaaatcaccatggatttcgtagttggtcttccgttgacggcgaagaagtttgattctatttgggttattgtggatcggctgaccaagtccgctcatttcatcccagtgtgaactacttactcagcggagcggttagcgaagatttatatcaggaagattgttcgcctgcatggtgtcccagttactatcaacttggacaggggtcctcagtttgcttcacggttctggaggaccgttcagcaggagttgggcacttaggtgactatgagtacatcatttcacccgcagacggacggacagtccgagcgcactattcagattttggaggatatgctccatgcgtgcgtgattgagtttagagggtcttgggatcagttcttgcctttgacgaaatttgcttacaataatagttagcagtctagcatccagatggcgccgtatgaggctttatatggtaggagatgtagatctccggtgggttggttcgagccgggtgaggagagactattgggtacagatttggtataggatgcggtggagaaggttaaggtgattcaggagcaactccgtacagcccagtccagacaaaagaattatgcggaccggaaggttcgcgatgtttcctttatggttggtgagcgggttctgctccggttttcacatatgaaaggcatcatgaggtttggaaataaaggaaagttgagtccaaggtttattggtccttttgagatttcgagccagattgggaaggttgcctacgagcttgctttgcctcctagtttggccggggttcatccggtatttcatgtttcgatgcttcggaagtatcatggtcatccgtcttatgtgttggagttcacttcagtccagttggacaaggacttgtcctatgttgaggagcctgtggcaatattggacaggcaggttcgaaagctcaagtctaaggagatagcctcagtgaaggttcagtggcggggccagccggtcgaggaggcgacttgggagaccaagcgggatatgcgcagccgttaccctcatctatttgctactccaggtatgtcttctatgctcgttcgaggatgaatgaatgtttaagtgtgggaggatgtaacgacccgaccggtcgtttttagaatttgcaccccgttcccccgttaactgcttcccctaagtttatttaagctattttgatttgtcgggaggttcggtatttgaatccggagtgtttttggacaaatagtccttaattgagagtctaagtgttggaaagtggtccattgtcagaacagtgtcaagacgacctcgaaatggaaatctgatggttccattagctccgttaggtgatttcggggttgggagcgtggccggattgtattttggatgtccgtagctcaattagcctagaaatgccgaaagttggaaatttggaatatccggtccgatagtgaatttttgatccgaggatcggaacgaagttccggaagttgctgtagcaccgtcacgtcatttgggacgtgcgtgtaaaatttcaggtcattcggacgtggttaggataggtttttgatcgaaaatgatttgggttaagttttggaaattctaagttgaaatcaatgagtgattcgtgtttccggtgttgttttaggtggtttaaggatttgtacaagtccaaatgatgttatgggttataattgtaagtttggttgaggtccggggggcctcgggtgtgtttcggatgttcaatggattagatttggaagtagaagggaaaaattgttgcagaccttctgctatttccacttacgcggaaaaggagccgcacaagcgaggtccgcttaagcggaaagtgggtcgcagaagcggacgttaccgcataagcggctggtcggtcgcataggcggagaccgcttaagcggtcaattagccgcacaagcggccgctgtacttttaataagaaactgcagaagcggattttgaaccgcacaagccttaccgcgtaaacggtcaggaacccgcttaagcgaaaatcacagtagaaatgggtttaatccgagggtttgatttcataagttgaaaaaccaattcttagctcggaccaaggcgattttttggaggatttcaaagaggagattattgggtaacgtttctatgatcatttctagctttaatctatcatctagttgcttaatccatcttttaaattcaaattgaggtccaaaaatggaggaaatgggttaaagttcctagtctaatcaatttgggtttttgagtgagtatttgacctctggtttgggagatttttatatggttagactcgtgagagtgtgaggtttctgaaagtgtaaaaatattcttattccgagacgttggtcttagggacattttggtcatttacctattttcgcgccgtagcttcaattttattagtgtaattagtttattgcgttgttatttatacattgtaactggtttgaatagattcgggccattcggagttggatactcgtggcaagggcttcgcttcatattgattttggtaccggttcgaggtaagtggctagtctaaccttgtgtgggggacttctccccttaggatatcttatttgctattttaaatgccttgtgcgtgaggtgacgggcgtgtacttgagctagttgttggaatttcactttacttgggatacttagtctgtacctattcaattattagactgttagatactagttacttgtgttaatctaggaaaagcatgttagttgatttagctgccctatttgactttgttgcaatacttgtttttccgtgaagcatgtctcacttagtattttccttgggtttgtactactgcgttgtaattatgagtttttcctatactttggatattctgagactggctgtgcggatactaagagatccctggcacgtgattaattataattgaggataccaggagatcctcgggatactaggagacccctgttgcttattagaggatactgggagatccgttgtgaatatttgaggataccggagatcctcgggattccatgagatccccgatggctgctagtttgtattaatcgtttcgttcatagattgtttttattcgaattgttacattgcttattatcctgttagtctcttaaattgctgtatttctccgtatttatattactgcttcatttatattatctcagtagggcctcgaccttcctcgtcactacccaaccgaggttaggcttggcacttactgagtaccgctgtggtgtactcatgctactcttctgcacacttctgttttgcagatccaggtacttccggcatggcgtttcagcagtgagtccagagcagctattcaggagacttgaggtatacatctgccgcgtccgcagatcctacgagtcctccttctatcctacccgtatctttgatagtagttgttctgttatcccttgtattagacttccagatgtttagagcttgttatattaaaaattcttagtctgtgttgcccgtgagtttccgggttttgggaatgattttaggggaattataaatgctaagtgtatgtgccgggcggtacttattacgtttcttatattatttcagttcttattgtcttatcttatgagaatgttatattccacaatgagtatggcttacctggccttgccggtcaggtggcatcatgacaatgttcacggtcggtgaactggggtcgtgacaattaagactcggtccgtcccgtgagatgcgatgtctaatagctattatctgtggttatgtatttacttgttgttgaacttgactaccttcatgttagatatcatgcttaggctttattcatgcttacattatttttactcagtcatgtttacctcagtctctaatattgctaatatgccgtgatacttgatgtgggttgtattcccttatttgttgatgatggtgaggatagtgaggtacatgattgagtaaggccaagggcctggttgtgaggatattaataccatatcgcgtgagttgtccgcattgcatgtgagttgaccatgcgggtccaggtattgataccatagcgcgtgagttgtccgcgtagcacgagagttgaccgtgcagatccaggtattgatatgatggcacgtgagttgtccgtgcttagcgcctggggtttgggagcccctccggagtctgtacacacccccagtaagcgcagagtgttgagtgtattgaatgttgagtgttgagtgctgagtgattgagtgacattgctgtgaagttgcatctacttttgttgttattgcatttatctgttaaatttttttgtggtatttactgagttatagaatttacctgtttatttttaaattgtaaaaataataattggactatttttcttagctcgtcactatagctcagttccttagttaattctgttactactgaggtggtagtactcatagtacaccctgcactttatgtgcagatccaggtgagttagacgcaacgattgttgatttcaggccagctatctgtggagattgcaaagtagctgctagtgtccgcaggaccttgttactcctcttatcatttcttcttttggacagttagacagtttatatatcttagtttatagttttagacgctcatgacttagtgacaccccgatgtttgagactcatttccgttttttctatattatatttagagttgatttagtttatgaaaaacttaaatgttaattttttttattaattttgtataattggtttagtagtaatattttgggaagtaggcttgccttgtaacacgataggcgcaatcacgaccatggttagattttggatcgtggcattcaaggataaaagaaggattttcttcctattgttcaaagcctttttttcaggattgggatcattgatatcatggaaaatgcctaaaaatgtcactcaactttgagaaatggtctattcatgccattcgttaaaaaaatacttatttcatgccactgacgttacacatttggcccatccatgccattattgactaacggttcaattttatttggctcatccatgccactgtcgttagtcaataatggcatggatgggccaaatgtgtaacgacaatggcatgaaatgagcatttttttaacgaatggcatggatagaccatttctgaaagttgagtggcatttttaggccttttccgttgatataaaaaagtggttggttgacatcatactagaagtaccatgaaactaactgagttccaatatggtaacttctttttctatctctattgcatttcttaattttttgttaaatatcccagtatgttttattgatctgattagtcttaccactactttattaaagagtaactcaaacaggtgttggaagtattgttatttgtgttagaatacaagaaattctctcccggttcattcctactttcatcctctttctgaatctatcttctggttctacttctgagatttgatctctatgttctgcttctctcaatggacttttacgcttactgtaatttttcataatataatttaatttattttctgggaaacatgccaacattcaatgtttggaattattcacactaccaacgacgttttgttcttttacttcctgtgtagcacttatttagaaatatttctaccagtattgcaaaaaggttatacctatttttcgacttatacttattcgattccatattgtccttttggttttctgttgtgtttgatatatgtaacactacagtttatactttgaaacctcacagtataatagtaattctacttttgaaaatattaatgtttttgtcaatgaagttttagaataaaagggtttgccagaatgttttagacaatttacttgtagttgagcagatgcactaataaaatacatcttttccttgaagaacttacataattacataaacgtagccaaataatttaacattaaagtcatttatacttatttggaactttctacttcaataattattaccactaacagtttagatgcactatttgatggagaacttgtgatgtttgtagcaaaagttctcaagtaagaactctaaggagcaacaactgaaagaacgatgattttggtcatttcaattatttcctctgtagaagactacttggttctattaaaaaaatctaaaaatttgattttttgttagtgaagaacatagctttttaacttggttgttcatgaaataagaaagtctgtgaaagaaggaattatgtcttctatgatatctagagttattagctaaccttatgttgctattatctgctttgttgctctcattatcggtagcagacaaaaacaacaacatacctaataaaatcccaccagtttatcggtagcaaagttttctcatttatgtttcttctgatatatcgctccagtgccatttgcacctgtcacgacccgaaattaccaccatcggggtcgcgatgacgcctactgtcggagctaggcaagccaaccaaacaaggaataaccaactaattacttcaacaaataataaatggaaacaacgattaatcatacaggaaagtctcaaatttaattaaagatagaacggaatgcggaagtcaagcatatgatatcctctacccagaattattgtgtcacagcatacacagactattaagaagttactacaaccaatggtttgaaagagtaaatacataagcatttgtctgaaatgataaacaaactacaactaggaggagactgagagggcccacgaacgcctgtgaactacttagcaatctctggactgaaggcgcactccccgactactgctgctgctgctcgatgaaggccgctcccggatctgtgcacaaaaaggcacagcaagagtagcatcagcacaaccgaccccatgtgctggtaagtgcctggcctaaccccggctcacgaggtagtgacgaggctagacaggacctacaacatataaacatgtgcaagaatagacatatacaagacaagaatatgtagatttaagcaataataaggggaggggacatgctgtgagggtacaacaattctaatgcagaacgcaactagaaggaactagagcacgacaattaacaaccaatgggaggatgttaatttaactcaacataagcacaaaatcatcaattcatactccgttgcggcgtgctacccgacacttcgactatttcattaatatttcgttgcggcatgcaacccgacccttccgaagtatttatttcatatatcatgccattgcggagtataacccgatcctcaacatgtatataattatcaacccaaacatcccatcacgggagaaaccaatgcacatatgtctatatccaacaaggcaataatcatcaatgcatagctaacaccacattcattagccctaggtcgagcaaataccccaaattattcaagtggcacatttacatcattaacctttcatattcggtagagattatctttagaacatgaatattccaatacaagcaagaagtacatagcatatcaaatgaattaatacaataaagacccacggtcatgcttgactcgggtgtatagataaccgtcaccaaacctatacaccgactccacagttagcacttagcaattaacaccctaatcctattccctcaaaccaaagttagatcaaacacttacctcggcaatcaagcctctaacaccacctttcctctagaatccgactcccaaacaacgatatctaatcataaattacccaaatggattaacaagtgctaattaaactaatttgaatgcataagaatgagttttccaagtttaacccaaaaattcccaaaacgccctcgggcccacgtggttgaaactcgaggttcggaccaaaaccgggtcacccattccctcatgagctcatatctataattagaattgaaatcggacctcaaatcgaggtccaaaagctcaaaatatgaaaaccctagtttctacccaaatctccatttttaacccatgaaaagctttgatttaagatgaaatcatgctagatgatgatgattgaagaaaacaagtaaaaatggacttacaatcgaattggagaagaaagagttgagagaaaatcgccaagagggttttgggttttgaaataatggaaatgagcttcaaaaatcgtttaagtaatttttacacagatgcggacttcgcaattgcgagattgagttcgcaattgcgaactagcaggccaaagcgggaatctcgcatttgcgagaaacaattcgcaaatgcgaagtgggctgaagaaatggaaatctcgcaattgcgagaaagacttcgcaattgtgaagtggctgaagaaaaggggaaagtcgcatttgcgacattaagttcgcatttgcgaactggggctggggaaaggggacattgcatttgcgatgtaaaactcgcatttgcgaggtttggagtgaaaatgagggacttcgcatttgcaaagtcaaactctcatttgcgagattggctagaattggaccccttcgcaaatgcgaagcctctaggtctgaggcacctgctgcaattccaaccatgcaaaaatgcgtccgacacctagccaaaacactcccgagccctcggggatccaaaccaaacatgtacactacctcaaaaagaccctacagacttactcgtgcgatcaaatcgccaaaataacatcataatcaatggattaaaccccaaaatcataatttcactctttaacacatgaaacttaagattttctatattcaagtccgaaatacgtcaaatgacgtccgattcacatgaaacttcacaaataacgcttaaccattatatatgacttgtaccgggcgtcggaaccaaaatacgagcccgataccattacctttttgtcatttttcaaattcattttcctttaacattaacagcaatcaattaaactgaaaaattgtttcctggggcctgggacctcggatttcgattccgggaatacgcccgagtcccatattttcctacggattttttgagactgtcaaatcacgggtccgggtctgtttgcccaaaatgttgatcgaagtcaaccatatcaatattatacttgaaatttatcattttaaatatacaattcaaatttcttaacatcaaaactttccggcttcgcgcccggactgcgcacgcaaatcgaggcaacccctcaagaggtcttcgaggcctcagaagcacggagcaagggagaattacggtgatgaccctttggttcgtcacgatctccacctctaaaataaccgttcgtcctcgaacggacaaaagaaggaagtacctgagtcgggaaacaaatgaggataacggctacgcatatcagactcggactcccaggtcgaagccttagggggctgacctctccactgaacacgcactgaatgaaaactcttcgacctcaactgtcgaacctgccggtctagaatagccaccggctcctcctcatatgacatatccttgtccaactagacagtgctgaaatctaacacatgcgatggattgtcgtgatacttccggagcatggatacatggaacactggatgcacagctgataaactgggtggcaaagcaagtctataggccacctctcccactcgctccagaatctagaacggaccgatgaacctagggctaagcttgcccttcttcccaaatctcatcacgcctttcataggcgacacacggagcaatactcgctcaccaatcatgaaggcagcatccctgaccttgcagtctgcataactcttctacctagactgagccgtacggagcctatcctgaataatccggaccttatccaaggcctcctgaaccatatccgtacccaataaccgagcctctcccggctcaaaccatccgactggggacctacaccgcctaccatacaacgcctcatatggagccatctgaatgttggactagtagctgttgttgtaggcaaactctactaatggcaaaaactggtcccacgagcctccaaagtcaatgacacaggctcaaagcatatcctcaagaatctgaatcgtcctctcagactgacgtccgtctgttgatgaaatgttgtgctcatctgaacctgagtgcccaactctccctgcaaggctttccagaaacgcgaggtaaactacggacctcgatccgaaatgatagatatgggcaccccatgaaggcggacgatctctgtgatgtaaatctcgactaatatctgggatgaataggtggtagcaaccggaatgaagtgcgccgacttagtcagcctatccataataacccaaactgaatcacactacctccgagtcatcgggaggccagtaacaaaatccatggtaatcctctcgcacttccactcgggaagctcaatcctctgaaatagaccaccgggtctctgatgctcatacttaacctgctgacaattcaaacaccgagcgacataagctactatatccttcttcattatccgccaccgataatggtgtttcaaatcctgatacatcttcgcggtgcccgggtgaatagaataccgagaactgtgggcctccgctaagatcaaatcacgaataccatcaacattgggcacacaaaatcgcccctgcaatctcaacacaccatcactccccaaagtcactttcttgggaactcctcgctgaaccgtgtctcttaggacacataaatggggatcatgaaactgaagctcacgaatacgctcaaatagatatgagcgggcaaccgtgcaagccaaaactctggtgggctcagaaacatccaacctaacaaaacgattggccaaggcctaaacatccaaggcaagcgatctctgactgactgggatgaaagcaaggctacccatgctagcagactttctactcaatgcatcggccaccacattggccttccccggatgatacagaatagtaacatcataatctttcagcaactctaacgatcttctctgcctcatatttaattccttctgtttgaacagatactgaagactcttgtgattggtgtaaacttcacatgtcacaccatataagaaatgcctccaaatctttaaggcatgaacaatagctgccaactcaaggtcatgaactggataattcttctcgtggatcttcaactgcctcgaagcataggctataactttaccatcctgcatcaatactgcaccaaccccgataagggaagcatcaaaatagactgtgtacggtcctgaacctgtaggcaacactaacaccggtgccgtggtcaatgctgtcttgagcttctaaaagctcgcctcacactcgtccgaccacctgaacaaggcaccattctgggtcaatctggtcataggggatgctttggatgaaaacccctctacgaaccgtctgtaataaccagctaaccccaagaagctctgaatctctgtagctgaagctggtcgagaccagttcttgactgcctctatcatcttcgggtccacctgaatacctgctgctgacacgacgtgccccaagaatgtgaccgaactcaaccaaaacttgcactttaagaacttagcatacgaactgactatccttcagagtcggaagaaccactctgaggtgctgctcatgctcctcctgactgcgggagtatataagaatgtcgtcaataaacacaatcactaacaaatctgatacggcctgaatactctattcatcaactccatgaatgctgctggggcattagtcaatccaaacgacatgaccaaaaactcgtagtgcccataccgagtaagaaatgctgtcttagggacatcagacgccctaatcctcagctgatgataactagatctcaaatctatctttgaaaataccttcgaaccttgaagctgatcaaataaatcgtcgatcctcggcggtggatacttgttcttaatagttaccttgttcaactaccggtaatcaatgcacatcctcatagaaccatctttcttctttacaaataatactggagcaccccaaggcgaaacactgggtctaatgaaaactttctcaagcaaatcctgaagctggtctttaaactctttcaactctggcggcgccatgcgataaggtgggatagagatgggctgggtgcccggcgccaaatcaatatagaaatcgatgtccctgtcgggcggcatgcccgacaaatcagaagggaaaacctctgggaactctcgaaccataggaacagaatcaatagacgggacctcagcgctggagtcgcggacataagccagataagctagacaccccttctcgaccatgcgtcgagccttcacataagaaataacactgcgagtggtatgaccgggggtccttctccactctaatcagggcatatccgacaacgccaaggtcacggtcttggcatgacaatccaagatcgcatgataagaagacaaccaatccatccctagaatgacgtcgaaatccaccatatccaacaataacaagtcaaaacgggtctcaagacccctgaacaccacaacgcacgagcgatgaacccgatctaccactatcgaatcccccactggagtagatacatgaacgggaataccgaaagcctcactaggcataaccaaataaggtgcaaaatatgacgacacatacgaatacgtggatccaggatcaaataatactgaagcatctctatcacaaaccagaatagtacctgtgatcactgcatcggacgcctcagtctctggtctggctggtaaagcataacaatggggctgggccctacctccctgaatagcacccctaggctgatctgctgctgtctgacctctacctctagctggctgagctccacctctaagacctctgcctccacctctatgacctctacctctagctgactgggcagactgtggggcaggtggtgcctgaatcatgggacggggtccctgttgctgcgaccgagcacctctcaacctcgggcagtatctcctgatgtgactaagatctccacactcatagcacccgtctaaatgctgcagctgagggagctgaggctgaccctgctgaccagaatgaccacctcggaaactctgaagtggcggtgcactgataggctgctgaccagaataatactgctgagaactgctgctacctagggcactatgagaggcctggagagctgactaataaggcctcgggggatggcccctaccatatgaacctctacatccagacgaggtaccactgaattgaccagaatgacggggcctcttatctgacccgaaaccacctcccaaggaaagtgccatctcaatccggcgggcaccatccgccgcgtcctaaaacgagagatcactaccggcactcatagccatctgcactcggatctccggagtcaacccatccacaaatctcctaactctcttgccctcagtgggaagtataaaaataacatgacgggaaagatccaaaaatcacatctcatactgagtaacaatcatagatccctgctgaagacgctcaaactgacgacgaagagcatccctctgagtaacatggagaaacttccccagaaacaactccgtaaactgatcccaagtcaaagctggagaccctgctggtctagatagacagaaatccctccaccaagtcttggcggatccagccaggtgaaaagtagcaaaatcgaccccattggtctccagaatagccatagtcctcaagacctcatgacagttaaatataaagttctgagcatcctcataaggcgtaccactgaaagtatgggtgaaaagcctggtaaaacggtcaagtctccacaaagaatccgcgaacatagccgcaccatcactagactggcccgcaataactggctaggctgctactataggctgggctggcataactgacggaactggcacaactggctgaaccggcacaactggaggagttggcaccgtaggctgaactggggcaacctgctgcactggtggtgcctctggagtctgaaatcccggcgcaactaggtcaggtgtgcgagcaatgggggtctgattgcctccccctgtctgtgaagtggctgcttgatcgtggcaaactcaatccgaagaatgagcgggctagaatactaatacctaatagtgtatcggggttgataattccatagggagcttcaatttggagatgagtagttgtatggcctagagatgtgttctaacttctaattggtcttctatcatttttgggttttttaagtattaatatctaaaactttcaactactattaagaactataattatgctaagttatgctaatattaggtgtatgcaataagagagaaaagcactagggtcgtgacacgtgcctaggcggataatcaacgggtataagattctaatacgagaatgttaaatatggggaatatggataaccgttgcactaatagtactcgctctcacacctcttggtagagagaacgatttttcccaattgactctctcgagaccaattgggtaggccaatttgcctaagcaactcaaggtttaggtaaggtaattactctcttgagatttaacctattacttgggactaccattcttatgggtccatcctaaatccttgttgggttgagggcgaggtcttagactctctttctcaagaagagtcaaaacccactaagcttgacttagtgtttgcaagcaccaatcatagtaaaaatatacacacaacccaaatccaatcacccaatcaacatccaagaattaagcaaaaacacccattaattgcccacaatagggttgagtcacaaccctaactaatgggtttagctagacatggaagaagtagaaactacagaaataatggagaagatagacataatcattaattagaagttaaatctacttgaatccactttaattacacaagaaattgcctaaaacatgctaagataatagctcatgagcggagctgctagttcagagcataaaacttaacctaaaaaagtaaagtgtgctatttatactacacagtaaaatctagacaaaaatacccatgaggatctgatgcgggccgcacagaaatggtgtgcggccgcacaaggtttaagtccccacttcagttgcagcctgagtagagggatgcagaccgcaccaaagtggcatgcggccgcatagggttagccatgcggaccgcactataatgatgtgcggccgtatctgaagacttggcaaaaacacttctcctatgaactctgggcatgcggaccgcaccaaagtgacgtgcggccgcatctgtctttgagctaaaagtcatggcctctgattcctcgagcaggcagaccgcacagaaatgtgtgcggccgcactgggcttgtcctaaaaacatcatctctctaataactggcatgcggccgcataccaaagtgatgcggcccgcatgggcttcctgaaattttggccatctctctgattacgcatgtgcggccgcacaccattatcaggcggccgcacataagccttaacttccacattttgtcaacttcttgtcgcttggccggtttcactcctttttgagccgatttgtgattttcatcatcttgtcgctcaaacctgcaatcaagtacattgttaagtgttttggaactaatcagaggcaaagtaagcacaaagataaggtaagaaagggcataaatcatgtataattcacagttatcaactccccgaaacttaaacctttgcttgtcctcaagcaactaaaatgagacacatccctcaatagagaacattccagaaatttctgtttttcctaaagtgacctcaacaagcctcaattgggactaacaattgtctccaatgcaaatgaatcattaacagttttaaaactttgcaaacttgcggatcaatcatgacacaagagcttcaagggttgacacatttcgtcatggagctttttctcaagtacttcggtcattgtggaacccaaactcgcacatcctcgactctccctaagtgaacctcacctttttgaatatattcacgcaaattgaggtggaaaaactctctcactcaatcactcagaaagaagagaccctaagtccggctctaagtaccatatgcttgccctttatgtaagtattcactaatgtaggctttcctcgatttaagatcatgtaggacttttgaggagtcatcgtgaaggcttttgggtatgggttgagcaattgttcacattggttcaatcttcctttaagcgcttcttttgtttcatttttgcacactctcatgactcaaatatgcaattcacctcttcaaagggggtagagagacacattgtcactctttcttttgcatttcaaaccttttttcttctcttgtctactttttcaacctctttccacctttttcactttattgttgtactttgattccctttttgattcttattctctttttgacttcctttttgtctttttctctttttcattgccttcctttttcttttgcttttgtacctactaccacatggtttcctttcttgtctctccccccaaacttagatatttgtcactactcaagggaagatttgggtgccaagagaaggtttaattaagaatgggtataggaatgtaacttggtttgaaggaacaaggtctaaggctcaaaagggtgaactagggatttttgtattagtaggtcatgaaattggttgagataacatttttggatcaaagggggcctacaatcacttctcaagtcaagttctacctatgatttcgcctcaacaaacattcggggcaagttctagaccatcggctcggcactcgggctcgcaaatcaaactcttaccacactaacactcaaagattgccaaagatggagtcgagggcccaacacgaccttagatatgatttaaacacacaatggcctcacacgaccatatgacggttgcttggtcaacacaagagtctcaaggccattactttcaccatcttaaacacaacttgatgtctttgaccataagatcgaaggcaaatgtgctagccccaactgaagcgttgcctgaggtactctcactacaagaacttgaaaaatcaaaaagaaacaaaacaaaagaactgactcaacccttaagaaagttgtcacgctatctatcattgggaagagtcacccggtttacacaacattctacccctggaaagaaccgtggcattaagaaaaccaagggcttatttcacaaaaccaaaaccaaaaaaggaagctacgagcctaagttagcactaaaacaaaaaaatttgcgaaaataataaaaataacaaagaaactcaaacgagaaccaaatgaatatatacataggggaagtagaatatacaactaaagggaaattcagaattttaaagttatatacaaatcatctatctatgaaaatgcaaaaagtaaatagtaaaagtatatacagtcatccagaatccaaataaatcaacaaaaagtagggccacacccccacgaataaaagctagcattgtccccaatgctaactattaaataagcataaaataagggggaaggaagagaaatggccccccaagcctgatccaccgctgtctgctgctcactagtagttgtgccctctgtactggtggggacctcagatcggcccccagtctgctgctgctgtggtgtagggacatcagttgtctacttagtgggtggtatatcagctgcctctccaatgctgggctcaggtaggccctctggtgctggtgccacctcaatcactactcccttagtgcgtgggagctttctcttcttcctcggcctctcctcgggctgtggctgagctgtgactgcctcatccactggctctccaagtaataaatcaaggggcaactggtctttcagaattttatccacatcttccctcagcttcttcacagagtccttggaagctctgtccttcctaagcttctggtgctccttagctagctccttgaggtccttgctgtgagctgccactgctttctccaggtcttcctgcttcttcatcatagcttcctggtttttccaggatcttcttcaatgtctcctcaagtgaagtagggaactccacagtaacatgtgccctctgagtctctacagctgtagacaatatggacaacttggaagtcgcatccgacatccagttgttcacactggccaaagtctgagtcagctgatatgcagtaagcccataagtcttggacaccagaaccaccggctccgcagaagtggaaggaggcacaggaagctgtacagacgcaactggcttatcagactggccagctacagtggaggtcgatgcttgccctttcttggcgcccttagggttgtccggccccttttgatcataccatgagtacgggcccattggatgcacctccgtgtcataatacttcttgactaccttcatgtagtaaaagtacatggtaagggtgttggggaatggatagttgtgatcagttgcccgcctcactctggtgattgccctctgcataatattccccacattcaacgggaaacccgccataatggagcaactaacactgctcgctcgagaggcaccgagttgtcatgggtggacgggtctagcctggagcatacaaatgagagccacccttttgcctcgaagctcaaggtgttcctaaatattttggttggaggagccaaccatgctgggacagtgcctggagcagccatgatttgagccaaccacggacgcacctccactttctgtgctagcttcaccagatattgggactcgtcttcctcatcgaaccccaaaaactcattcagagttttgccatcatacaagactacctggttcctcactttggttgttgtggcacccgggaccatgtggtgaacattactgtagaactccttgaccatatgctcattggccatgtccactatttctgaaaaatgcccccacctcgttcttgtgacaaactggtcatgcacatgtggattgtgcagcagcaaatcagctataatgaatctccgctacgggattagctttctcaacggccaccaagatcggaacttgctgaaggctattggactgacaaaacgctccttccacacctcctccttctttgttctctcaacctccccgacttatggttcaccacctttactctcttccccttcactctcttcccttgcactctcttcccctgatgatgacattttgggggaagaagagtgctcctcctcattttctttctcagcctcagactcatcagacgagtccgagactacatttccccgctttctggaagaggccacattctcttgttctttctcttgggatgaggacactactactggtacttcaatcgacctccgtgaaggaatggactcggaggttatactacgggagggaacatactcactgccagtggagtgagatgcagctctgtctgcaacccggatcatttttcttgtttccttcattttctccctttctttaggagtgagctttattactcttcggaccatctttgtcttaggctcacctccccttgccggttgtttgtccttacccccacgttgcacttgtttgctctttggaggcattgtctgcataagaacatcatctagcattgttagtgaaagcacgagaggcattacacatttgcaaattcaaaacagatggcaggtaatattatttcagacagccagatgcggccgcaccaaaatggcatgcggcccgcattggcaaagagtatccagctgatcaatctcagaacaacccatgcggcccgcacaaaagtgggatgcggccacatgaggacctagtgcggccgcaccaaaatggatgtgggccgcacaggtgagcatcagaaaagtctttgtttcagacaaccaggtcatgcagtccacacaaaactggaccgcggccgcacaagaacaaaccaaaaatatgcatctttcacacaaaaggttgtgcggtccgcacaaaattgggatgcggccgcatcagcaaaccttaaaatgacacctcctctgatacagggccaatgcggtccgcacaattttggaccgcggccacgtggagaatcaagcggcccgcacaataatgtcatgcggccacgtggagggtttcttttgaaagtcagtcaaagtatgcggaccgcacaccaaaattgtgcggccacctagggcaaaaattctaagcagggaggttttttttgaaattttaagcatcacattcaagttcaaccctaaattagtccctactcgattttacaagggtttggcttatgcccatgcttggaaactaagtacacaagaatctatatctaatctaaagcaaaagagtgaagaaaaaagaaaagtaggaagctattctaacagggaagcattttaaactaacaattaatcaattaaaacatagcatggatttgtagaatgttaccaggcgtgtacaggagatgagatgataagcaattagataaaaagtaggagatgaacagtagaaaatatgttttggggtgaaaatttgcgaaaagggtaacaagtgagcccaccggtctatttatagacagacggtgggacccattcctacctacctgtgcggccgcaccaaaatggcatgtggtccgcacaggatttttccacctggggagttcaaacagcccatgtgggccgcacaaaaatgggatgcggccacatgggtggtcttcagagatacacaattgaccctgatgatgcagtccgcacaattttgaagtgcggccgcacttaggtcttatcagagcactggcagttttcattttgacccatgcggactgcacaaaaatgccatgcggccgcgtgggtgttccttgcattttccagcctactcaagcaaacccatgcggtccgcacgaaaatgaggtgcggccgcacaggcactggacagagtctatgcaattttttatcttgatttatgcacacctatcctgcaacactccatgcacaaaccattagctcaaaaatcctatcctacaaaagaaaaataacacaaatgaaaagacatgggttgcctcccaagaagcgcctgatttaacgtcgcggcacgactttagttaccatcacaatcatttcaagtgaaggagcgccaccacatggcgatcatcaaacttgaccaaatagtgcttgaccctatgcccatttacacggaacacttcaccattcttgtttttaaggtcaatagcaccaaaaggtgtaacaccaaccacctcaaagggaccgctccacttggacttcaacttttccggaaacaaccttaaccgagaattgaagagaagcaccatatcacaaaccttaaactctttccctcgggcatacttgtcatggagatatttcattttatccctgtacaaagatgaactagaatatgcatgaaaccggaactcatcaagctcattcaattgttcgacccggagatttgccgcaacatcccactctagattcacctttttcaaagcccacatcgctttatgctccaactctaccgggagatgacatgctttaccaaaaaccaaccgatatggtgacatgccaatcggagtcttgaaagtcgtccgataagcccaaagagcatcatccaatttcttcgaccagtcggtcctatttgcattaaccgtcttggaaagaatactctttatttcccgatttgagacttcaacttggccacttgcctgaggatggtaaggagttgtcactatgtggttgaccccatatttggcaagcaaagagtcgaaagcccgattgcaaaaatgagagccaccgtcactaattatggcacggggtgtaccaaatctagtgaaaattctcttgttcaagaaagccaccacactacgagcttcattattaggcaaagccgatgttcggccaaaaatgcatatatttatccattgttatctcatattctagtacttttaatcgtcattcgagtattaattatattactttgtgcttaatattatattttaactgtgtaggaataaagcggtatgaagataaagagatttggagcaaaattgaattaaacgcgaaagaaaaagaaaggaaattaaatgaatataataaggggggacaccctttgatttttgtcccccctaagtggagacaaccaaggaattggacaattcataaaaaagagggagttacaattgagagcaaaatttgacaaagaaacgccaaagaaaagcgtactgttttcggcgctaaggctagcgcctcgcgttggtctgtacgctacctgtgtaggtttttctaattcgtttgggacaaggttatttcggccttacacagtcttaacttgtataaaaagggtcctaaacctaatttggaggagatctaacatacttagaaggggaaatcacgtggaggaacacacaccacgcttggaggaggcttctaactagtttttcttctcttctcttcctctaatctcatagtttatttgttctagagttttgggtgctacatgaacgttgtagtttgaagcttgaattgttctaattattttatcatattggtttatttattcaatcttgcgcttaattatttgattgcttgatcaccaattgaatactatctacgaatctaggattgaactcgggagagggaattctagattgcatataagattgaatagagcaagatcttaactcttagggggagcggatttgcggttaggataggaatatacctaatcgccttgcttggttattatacgggaattattaatgcgttcttgttaatcctaattccataggaatataggcgttaggttagcttgaataggcgagttgtacttcgggagaaggctacgagcaatattaaccctgtcaatcaataaactagataaattaattagacgatttaagtgaaaaactcaacgggattgttagctaacccatagctctagaatattcactcacattgaattcgtctctataatttgccaacttgtttcctttgttcttagtttactactctagattaattttagttaaatattcatactttagaattcgcttgaatagattaattgtttggtttaatttagttgatagttaatcacaagtccctgtgggtacgatatctggacttataatcctatattacttgtcgaccacgtatacttgcgtgtgcgtttgggagcaacaagtttttggcgccgttgccggggacttagaaattaactattttactagattagatttttactttttatctgtttaagtttttaattttagtttagtgtagttagtattataattttctttatggcatctttgaacaaaaaatggtgggatagtaagttttcttgtttttgtgatccttgtccatattgtaaaggaccccacttatggcaatattgtaagaatattcccaataccgagttgtgtgcaccatctcaatcatgtactatttgtgatggtaattggaataattgtcctaagtgttgttatcctactccaatcccttcttatgttgatcctaataattcttgtgaggttgacaggagtaatgaattggatgatgttgaacatgatcttgatatgcgcatgaaattattagaggaatatggaggtttccgtgagaaaattacgaatgagatacaatacttattagaaggaagagctgaactgggactagagatcgatcaatttggcaaatgtattcgcgacttggaggctcaattgagtgcaaaggttgatgcatgtaatgcccagcaatttagtgatgagttgtgcgaagctgaaaaagatcttctaggccaaattgaggagctaaaacgagaatatcaactattagaccacgctcttgtggatgatgctgaggttgaggaagtatgtattaccgaggatgtcaaaaataatgcagttttggagttagggcgtgttggtcctcattctaatcatttttctacattatggttggatggaaacatgtatatcgagcctttgaagagatgtatagatgaagaacaagatccttatattctgaaatttgccataccaaggagacaaaatgacatccctcacttaaaagccaagaagtgcaagatgcgatatctattgcttggttcctttatttttataccaccgccccaggaacgtgatggaaaaattgatgcaaaattgggggtgcaattcatatcttcaaagtggaaagaaaagtagtgaaagtgatggcgtcgtgccgcgacgttaaatcaagcgcttgttgggaggcaacctaattttatttttcttttttacttttgtttgttttttttattttattgtgttatttttattttttgtagtattatttttgtattttgtaggactatgagaatggagtcaaatccaataggcgagtgcaaaagcgagcagatggttgaaactaagtgtgaggtacccgcacaagagatcatacctgggagaagtctgagtatcccgtgagctgctaattcttcggcctttggcctaccagggagtctcttttaccttattattattttcagtgtgcattgaggacattgcacaattttaagtgtggggtgaggagattgtctgagtgattttctgtgctatcctagcttagttgtagtactcgttcttagtgtagtagtttttgtcaaaaataaaaatgaagaaaaaaaatagaaaattgggacttttccagatgatggattttgtggaaagctttcttgagggattaaggtccaataaaaaaaaatacaaaaagatttttttttctttttcttttctagttagttttagttaggtaataatcccccttggtttttctttgtgcatcggttctttttcaagggatgtaacttgaaccgggtaattttttatttttattttatttttaggattagatttttttttaggagtagaaaaagagggagaagaaaaagctttgtgacttgtttgataccaacatatttaggcctgagtttgagtagtactttcctttgagtgcttgagtaatgaataaaataacaggctttctgacacgtaagctcagggttgtgactctatatatagcttattcttattttgttgttcgctatgaccctgtctgtcttagagtggaattgatccatcttgattgatacttgtgccatgtggggtgaggatttcttatatatattccatgttatgcatcttagtctagaacttgccctgcatgttattgaagcgaaataaaagtcttgctctgtttagaagatgataataggctttctttgatatgtcttatgaattttagccttttcagatattgtaccactagttatccctttgagcctgtagccttttgtttggaagccgtatttttgccttgatccttttgttgaatccctagtttttgcaccctgcttccttgagcactgttgcttagaccgtgatattaattgataaatttaaagaatgggatggttaagtgaaaaatggtaactaatgatggctgaaaggtgatgaaaaggccctcttgaaaagaatgtgacttgaaaaaaaaagagaatgaaaaaaaaattgctttgaaaaaatatatgattgaaacgttcttgacatgagggaaatacttgtgaaacaattgatgaagagagggctgaaaaataaagtgaagagatgaaaataatgggtgatgaagtctaaaaatgcaaagtgcttagggaagtgtaagtcactattatataattctcctacccgtcccttagccaacattacaacccgttaaagtcctagttgattctattcgagcatacttaattagtagagatgcacataatgggcaagcctatggttctttgtgcatacatgtgaattcgtttgtgagtacgagagttgttctttgatgctaagtccttaaattatattcattctttgatttgagtgtatggactattcattcttgtgagggcacatgtttcatgatagataggtgatgttattagcttctttgacagagtaggtgagcgagcttaaatttggtaagttagagtccgtctttgaggttaggaggttagaagtttgttgtttgtttgtgacttgtatatcttgcacgatgatgaagaagtgtatatctgatgatttgagttgctataagcctaattgttagtatcaaccaaagtggtggtgtttctaggcttgatttattgagagtaattttaatgcttactcgaggacgagcaagagtctaagtgtggggtgttgatgttcggccaaaaatgcatatatttatccattgttatctcatattctagtacttttaatcgtcattcgagtattaattatattactttgtgcttaatattatattttaactgtgtaggaataaagcggtatgaagataaagagatttggagcaaaattgaattaaacgcggaagaaaaagaaaggaaattaaatgaatataataaggggggacaccctttaatttttgtcccccctaagtggagacaaccaaggaattggacaattcataaaaaagagggagttacaattgagagcaaaatttgacaaagaaacgccaaagaaaagcgtactgttttcggcgctaaggctagcgcctcgcgttggtctgtacgctacctgtgcaggtttttctaatttgtttgggacaaggttatttcggccctacacagtcttaacttgtataaaaagggtcctaaacctaatttggaggagatctaacatactctgaaggggaaatcacgtggaggaacacacaccacgcttggaggaggcttctaactagtttttcttctcttctcttcctctaatctcatagtttatttgttctagagttttgggtgctacatgaacgttgtagtttgaagcttgaattgttctaattattttatcatattggtttatttattcaatcttgcgcttaattatttgattgcttgatcaccaattgaatactatctacgaatctaggattgaactcgggagagggaattctagattgcatataagattgagtagagcaagatcttaactcttagggggagcggatttgcggttaggataggaatatacctaatcgccttgcttggttattatacgggaattattaatgcgttcttgttaatcctaattccataggaatataggcgttaggttagcttgaataggcgagttgtacttcgggtgaaggctacgagcaatattaaccctgtcaatcaataaactagataaattaattagacgatttaagtgaaaaactcaacgggattgttagctaacccatagctctagaatattcactcacattgaattcgtctctataatttgccaacttgtttcctttgttcttagtttactactctagattaattttagttaaatattcatactttagaattcgcttgaatagattaattgtttggtttaatttagttgatagttaatcacaagtccctgtgggtacgatatctggacttataatcctatattacttatcgaccacgtatacttgcgtgtgcgtttgggagcaacaaaagcgatggcctcaacccatttcgatacatagtcaaccgccaccaaaatataggtattgccacaagaactcacaaacggtcctataaagtctattccccaaacatcaaaaatgtcgaccccgagaatcgtgttaagtggcatctcgtctttctttgaaattcctcccgcacgttgacactcatcacatcttttcacaaagtctccagcatctttgaacaacaaaggccaatagaacccacaactcaacacctttctatccactatctccaagtcaaactcttgtaaaagaagcacccatctcatcaaccttgctttcgaatccttcttagtcatcaagtaccttagggcggcatgatcggtatgaataatcactttggcccccatgaggtatgtgcgaaacttctccatagcaaatacaatggcaagcaattgcttctcgatgaccatgtaatttttttgtgcttcattcatcgtcttgctagcatagtacaccggatggaacaacttgttggttttctggcccaagactgcccccaccgcaacatcactagtatcgcacatgagctcaaagggcaagctccaattgggtgcggtaataatgggggtagtcatcaacttgtgtttcaaaagctcaaacgcttccatgcacttctcatcaaatacatactttgcatccttttccaacaacttgcacaacacattcactaccttagaaaagtctttgatgaatcttcggtagaaacccgcgtgtccaagaaaaatcctcacccctttgacagagttagggggaggaagcctcgaaatcacctcaattttagctttatcaacctcaattccgttctttgaaattttatgacccaacacaattccttcttccaccataaagtggcatttttcccaattgagcactaaattagtatcttcacattgggccaacatacgatcaaggttttgcaaacattcaccaggagaatccccgaccacactaaaatcatccatgaagacctccaatatgtcctccaccatgtcggtgatgatggccatcatacatcgttggaaggtcgccggagcattacataacccaaatggcatccgcgagaatgcgaatgtgccataaggacatgtgaaagttgtcttttcctggtcttcaggggcaataagaatctggttatagcctgaatacccatctagaaagcaatataatgcccggcccgcaagacggtcaagcatttgatccaagtacggcaatgggaaatgatccttcctcgtgaccttgttcagctttcggtagtccatgcaaactctccaacctgtcacagtacgagtcggaattagctcattattatcattggtaaccaccgtcattccacctttctttggaacacattggaccggagaggtccatgaactgtcggagattggatacaccacactcgcatcgagccacttgataacctctttcttgaccacctcttgcatggcctcatttagtctcctttgatgctctagagaaggcctagcatcctcctccaatataattttatgcatgcaaaacgcggggctaataccccgaatatccgccaaggtccatccaattgcccgcttgcgcttttgaagaactgccaaagtggcgtcaacctacacgttagttaagcaagaagaaagaatcacaggaaaagtgaaattaggaccgagaaactcatacctgaggtgaggaggaagaggtttcaactccaacaccggtggctcctcaatagatagtttggtgggtggagttttccggttctcaagatcaagagatagcttccttggctcataagaatacgagcccataccatgaagtgcattcacacactccaccctttcgggaatatcctcaacatccatattcaagatcactacctcaagtgggtcttcaacattcaccattgagcttgtgtcatccactattaccgccgtgacaatgtcaacaaacgagcacacttcggtgctattttgttggcgcatagatttgcatacatggaaaaccactttttcatcaccaacgcggaaggtcaattctcccgcttccacatcaaccaaggcctttctggtagctaggaaaggccttccaagaataatgggcacctcgaagtccacttcacaatctaagatcacaaaatcggccggcaaaatgaacttgtcgaccctgacgagaacatcatcaataatccccaaaggcctcttcatagatcggtccacaatttgaagcctcatggaagtcgggccaggttgcccgatccttagagttttgaacacagaataaggcatgagattgatacttgcacctaaatcacatagtgcctttgcaaaatcggcactcccaatggtacatggtgttgtgaatgcaccgggatcctctaactttggtgccatggaatgaacaatggaactcacttggtgcatcattttgatggtctcacactccatagaccgcttctttgtaaccaagtccctcatgaactttgcatattcgggcatttgttccaacgcctccaccaaaggcacatttatagtcaaactcttcatcatctcaataaaattcttgaactggttgtcccctttttgcttgtccaatctttgaggatatggcgaaggaggcctaggcaagggtgccttggcttttggcaccaccggttcgggcatttcaatgacgtgttccctagatgggttcacggcctcttgggtctcctcctcgccttcatcaatatcgattctcacttcatttctcacacttggttcaacaacttcttcaaccactattggagcatcatcttcttgtacttcctcctcatcgacccttacttgattgtcttgcacaccaccacctctaccactacgcgtagtcaccgccataacatggttgttgtgcccacccttaggatttaccaccgtatcacttggtagtgcacccttcggacgagtgttgagggattgtgatatttgaccaagttgcacttctaagttgcggattgaagtgttatgggaggctagttgggcatccgagtcttggttcttcttcatcatttgttcaaacatgttttcaattctacccaaatcttgacccgacgaactttgcccttgagattggaacggcggtggattgtttggttgttgaaacattggggggctttgaaaccttgcccccgattgccttgatttcctctttgattgttattccatccaccattgttgttgttgttccaattgttgttgtttccgccccaattaccttgattaccccaattgttgttttggttgttattccagtttccaccttggttttgattattattccaattgccgccttgttggtttccccaattgccttggggcctccactgttgatttccttgaccacctctattaccttggaagttattcacatattggacctcctcgctttggccctcgtacccataattgaataacccccatttccatcatcataatcatcaaaactttttggaggttgttgttgttgttgttgtcctctttgccgtcttttcatcaaattcaccccctccatagcattcacttgacgcggactttgcacttgttgaagctgtgccttggccaactggttcattatggttgtaagttcggctatggcttgcccatgatcatgtaactcgttgtgcaagtgtataacattgagatcaccctgaggaacattagcacgaatttgccacgccgatgaagtatcggccatttcatctagaacatcacacgcctcatcatatggaagtttcatgaagttaccacctgccaactgatccactatgcactgattggttgtattgatacccatgtagaaggtccgctggatcatcacatcattcatatcgttgttaggacattctatgaccatcgtccgtaaactctcccatatctcatgcagggtctccgtcggctcttgcttaaaagtgaggatctcatctctaagagccaccatatgactaggcgaaaagaactttgcaatgaatttatcggccagctcatccagagtagtaatggtatgatttggtaatctctccaaccaatctaaagctttcccccgaagtgagaagggaaaaagccttagcctcaatgcatcttcagaaacatttgtttgcttaatccgccaacaagtatccacaaacccttttagatgcttgtaagtgttttcgtccgaggcgcctgtgaagtaccctcattgttcgagaaaagtaagcatgacattggtgatttggaaattccctgcccggattcggggaggaactattgcacttgcataaccctgattgggcaatatccgtggtgcacctcttggtggtggtggtggtggggggtctggaatcttgttttcattagcatttaccggagcatttgcatttctaccccgcctttgtagttggggaaaaacctcttcttgctcaacttcttcaacctcgtcccccaccacattaccaagaggattttgtccgtttaaagccattggtacctagatgaaattgacaaacaaaataagtaacaagaaggaaagagaagcaaaacacacaactagcacacaaatagtcaaacaccgtaaagctccccagcaacggcgccaaaaagtgatcgtggcaaactcaatccgaagaatgagcgggctcgaatactaatacccaatagtgtatcggggtcgataattccacatggagcttcaatttggagatgagtagttgtatggccaagagatgtgttctaacttctaattggtcttctatcatttttgagttttttaagtattaatatctaaaattttcaactactattaagaactataattatgctaagttatgctaatattagctgtatgcaataaaagagaaaagcactagggtcgtgacacttgcctaggcggataatcaacgggtataagattctaacacgaggatgttaaatatggggaatatggataaccgttgtactaatagtactcgctctcacacctctcggtagagagaacgattttgcccaattgactcccttgagaccaattgggtaggccaatttgcctaagcaactcaaggttcaagtaaggtaattactctctcgagatttaacctattgcttgggactaccattctcatgggtccatcccaaatccttgttgggttgagggtgaggtcttagactctctttctcaagaagagtcaaaacccactaagcttgacttagtgtttgcaaccaccaaatcatagtaaaaacatacacacaacccaaatccaaacacccaatcaacatccaagaattaagcaaaaatatccattaattacccgcactagggttgagtcacaaccctagctaatgggtttagctagacatggaagaagtagaaactacagaaataatggagaagatagacataatcattaattagaagttaaatctacttgaatccactttaattacacaagaaattgcctaaaacatgctaagataatagctcacgagcgcaactgctagttcagagcataaaacttaacctaaaaaagtaaagtgtgctatttatactacacagtaaaatctggacaaaaatacccttgagggtctgatgcgggccgcgcagaaatggtgtgcggccgcacaagggttaagtccccacttcagttgcagcctgagtagagggatgcggaccgcaccaaagtggcatgcggccgcatagggttagccatgcggaccgcactataatgatgtgcggccgtatctgaagacttggcaaaaacacttttcctctgaactctgggcatgcggaccgcaccaaagtgatgcagctcgcatgggcttcctgaaattttggccatctctctgactactcatgtgcggccgcacaccattatcaggcggccgcacataagccttaacttccacattttgtcaacttcttgtcgcttggctggtttcacttccttttgagccgatttgtgattttcatcatcttgtcgctcaaacctgcaatcaagcacatttgtaagtgttttggaactaatcggaggcaaagtaagcacaaagctaaggtatgaaagggcataaatcatgtataattcacaattatcactgctgcagcggtggctgagactacctgtgctaggcctgagcaagccgacataatctgagctagggccacctgaagacccggaataaccgtaggcacagttggggctggaacctcgtcaacatcaatccggggctccgccactggtattgctgcccggggctgagttgtgcccctagcgcggcctctagcgcggcctcgccctctgcccctagctggagttgctgctggggcctcgggctgctgatcagaagaacaggaagcttgagttctctccatctgcgaaggaacagagtagaaagacaatcaatgttgagaaacagaatcgcacaacaagaatgaacaatgtgagatttttcctaactctgtagcttctagggaacaagtacagacatctccgtaccgatccctcagactctaacgagtttgtccgtgagctgtgagactcaagtaacctagtgctctgataccaacttgtcacgacccgatattcccaccatcggggtcgcgatggcgcctactgtcggagctaggcaagccaaccatacaaggaataaccaactaattacttcaacaaataataaatggaaacaacgattaatcatacaggaaagtctcaaatttaattaaagatagaacagaatgcggaagtcaagcatatgatatcctctacccagaattatagtgtcacagcatacatggactactaagaagttactgaaacgaatggtttgaaagagtaaatacataagcgtttgtcttaaatgataaacaaactacaactaggaggagactgagagggcccacgaatgcctgtgaactacctagcagtctctggactgaaggcgcgctccccgactactgctgctgctgctggaagaaggccgctcccagatctgtgcacaaaaaggcacagcaagagtagcatcagcacaaccgaccccatgggctggtaagtgcctggcctaaccccggctcacgaggtagtgacgaggctagacaggacctacagcatataaacctgtgcaagaatatacatatacaagacaagaatatgtagatctaagcaataataaggggaagggacatgctgtgggggtacaacaattctaatacagaacgcaactagaaggaaccaaagcaggacaattaacaacaaatgggaggatgccaatttaactcaacataagcacaaaatcatcaattgatactccgttgcagagtgcaacccgacccttcgactatttcattaatattccgttgcgccgtgcaacccgacccttccgaagtatttatttcatgtatcatgccgttgcggagtgaaacccgatcctcaacatgtatataattatcagcccaaacatcccatcatgggagaaaccaatgcacatatgtctatatccaacaaggcgataatcatcaatgcatagctaacaccacattcattagccctaggtcgagcaaataccccaaattattcaagtggcacatttacatcattaacctttcacattcggtagagattatctttagaacatgaatattccaatacaagcaagaagttcatagcatatcaaatgaattaatacaataaagacccacgatcatgcttgactcgggtgtatagataaccgtcaccaaacctatacaccgactccacaattagcacttagcaattaacaccctaatcctattccctcaaaccaaagttagatcaaacacttacctcgataccgaaactagcaatcaagcctctaacaccgcctttcctctagaatctgactcccaaacaacgatatctaatcataaattacccaaatagattaacaagtgctaattaaactaatttgaatacataagaatgagtttcccaagttttacccaaaaattcgcaaaatgcccccgggcccacgtggttaaaactcgaggttcggacaaaaaccgggtcacccattccctcatgagctcatatctataattagaattgaaatcggacttcaaatcgaggtccaaaagctcaaaatacgaaaaccctagtttctacccaaatctccatttttaacccatgaaaagctttgatttaagatgaaatcatattagatgatgatgattgaagaaaacaagtaaaaatggacttacaatcgaattggagaagaaagagttgagagaaaatcgccaagagggttttgggttttgaaataatggaaatgagcttcaaaaatcgtttaagtaatttttacacagatgcggacttcgcaattgcgaactagcaggccaaagggggaatctcgcatttgcgagaaacaattcgcaaatgcaaagtgggctgaagaaattgaattctcgcaattgcgagaaaaacttcgcaattgcgaagtggctgaagaaaaggggaaagtcgcatttgcaacattaagttcgcatttgcgaactggggctggggaaaggggacatcgcatttgtgatgtaaaactcgcatctgcgaggtctagagggaaagtgggggacttcgcatttgcaaagtcaaacttccatttgcgagattggctggaattggaccccttcgcaaatgcgaagcgtatagatctgaggcacctgctgcaattccaaccatgcaaaaatgcatccgacacctagccaaaatactcccgagcccttggggctccaaaccaagcatgtacactacctcaaaaacaccctacggacttacttgtgtgatcaaatcgccaaaataacatgataatcaatggattaaaccccaaaatcataatttcactctttaacacatgaaactcaagattttctatattcaagtctgaaacacgtcaaacgatgtccgattcacatgaaacttcacaaacaacgcttaaccattatatatgacttgtaccgggcgtcagaaccaaaatacgagcccgataccattaccttttgatcatttttcaaattcatttttctttaatattaacagcaatcaattaaactgaaaaattgtttcctccggcctgggacctcggatttcgattctgggaatacgcccgagtcccatattttcctaaggatttttcgagaccgtcaaatcacgggtccgggtccgtttgcccaaaatgttgactgaagtcaaccatatcaatattatacttgaaatttatcattttaaacatacaattcaaatttcttaacatcaaaacttttctgcttcgcgcccggactgggcacacaaattgaggcgatccctcaagatttcttcgaggcctcagaagtacggagcaagggagaattacagtgatgaccctttgggtcgtcacagcagcactattgattttttctatgttttaccccactttttaatatcttgccacaattcgattttgtaatgcttttaattactaattttttgttgatcaagatgattatgttaactttccaagttaaaggtacttaaacaattttatatatggcacaacataaattatatttttgagtagagatatctatcagttcagcaagacaaccatgaaagtaaatgtccttgttagaagttagaattgcatactcacgctttagtgtccctattagaaattagaattgtacactcatgctttctaacttttaacggggttataatttcttcattagttgcctgcacgaggaatgtttctttgttattcccttggacaaatgattttgttaaactaaggtcttgctttggaccatatagccatcaacaaatatatccattctagattacatctcattgggaaaattgaaggatgtttggatcttgatggcattagcaagtaagagtgttataatgtaatccgattgaactctccaatatcctcattctttctatatgctcacctattggtagggactgggtaaacatattgctcttcaattgaagtttctgtgtggatttagctattgtcctgttggtgccctctcatcgcaagtgaaaacaacttcagtaaaagttttcctgttgctcatttcaagacttctgaagatggatatgtctgctatctcaagttagaccaagtattaggtgattaaaacccaactacttttttatttcttacattattatttttattaacatttgaatactcactttcttggtatatagattgtggatatatcactaagcaaagctatagatttggttggtttagcacaaagcataagttggtgggaagtgtgcgaagtcattctgctagtgttgtgacaacattttgtgtaagttagaaaacattatgcatgaaatgaaaaattagtacatataaatgggtgtaatggggattttaatttaccttgggtgtagatgtgctcggaagttgaggcaaggccattgagaggagagatacattttgagttcatgggaaacagaacataatagctttatcttattcaaaacttgtaacgacccgatcggtcgttttactttttagaaccccgttcccttaaataaaacttcccgtacttactttagctaatttacaacttgcggggatggttggttcggtattgaaagagttttgagtgaaatatgcccatttgattccttaggattctcttaaaagactaagtttgactagggtcaacattttgagcaaacagatccagatttgtgatttgacggtcccggagggtccgcaggaaaatatgggacctggaaaaatgtccgaaatcgaatttcgaggtccctagcccgagtaatgaagttttattagaaattattaatttgaagttttaaggatttgaagaaactaagtaatgattgatttcatgggtatcgggcttgtatgtttgttccgatgcctggtacaggtccgaaatatcagttaagactttttcgtaaaatttgatgttaatccgagtagtttaagggcgttttggcccgttagaggaaaattaagaacttgaagttcataagttttattcatttggttttaggggggtgattcctagatttagcattgtttagggtgtttcgaaggtacgagtaggtccgtctcataatttcagacttgtcggtgtgttcagacggggcccaggaacaccgaccatcaatcggacgaggctcgagtgaagtggaattttttagaaagagctgaagcttgctgcttctgtcataaccgcacctgcggttggttgaccgcaggtgcgagactgcagatgtggtcgttccatcgcagaagcggcctagggcaggccaggcaaggaaccgcagaagcggctccgcaaatgcggcctggaggccgcagatgctctttgagctctttggcccattttcgcaggtgcggcccatctctcccagatgcggtcacctgaccacagatgcggaaattactgggcagtgaggttcatttaataagtgttctaagtaatttttatcacattttcactcctccatttggcgatttgggagcttttttgtaacgacccgaccagtcgttttgagcttttacactttcatcaccaattctcgggcatgacttctcccgtgtgatgtattaggacatatgtaaatcgctggttttggtgtttggggtaaccggaatgaattttgaagaaacaattctcagttgaagcttaaaattcgaaaggtttgaccaagatttgacttgtttatagatgatctcggatcggaatttttatgattttgttagcttcgtatggtaattttggatttaggagcgtgcttggaaaattatttggaagtttgtagtttaattaggctcgaaatggcagaaacgagaagtcacagtttggaagtttgaccgatgggttgactttttgatatcgagatcaaaattcgactcaagaagttggaataactgcattatatcatttatgacttgtttgcaaaatttggggtcaatcggacttgatttgatatgtttcggcattgtttgtgaaatttgaaaattctaagttcttaaacttgaacgcgaagttgacttggtgttttgatgttggtttgaatgattcaaaggctcgactgggtgttaatgatgttatgggaggtgttggtatgtttgggttgaggtctgagggactcgggtctgtttcaggtgagttttgagcgagtccggacatttcgaaacttagaaaatggtttggggcagaagttttagcgctgggcgtggtggattaagtgttgagcgcagtggttttagtgcggccgcgaaaaatggtccaccgtacgcggtcatgaagaatccgcaggttgttggtccaacttcaggagctcatatctttcaatcagacaggaattatgatatgattcaaaaagaaacattgtaggtatttgaatctatttttcagaaacatattataataggcatttggacatctgtagcaaaggttatgtccaaaaaactaaaatctgtcactgtagaggaaaacctgtgcggccgcggtcatttttatatggactgcactggttttgtgcggaccgcggtcatttttgtgcggtccgcagaggtgaaaatcggtggggtactatataaatacgaggttttgggttttatttgatattttgacctagagagctcggattttggcgaaagtgattataactcagatttggctagagtacatgaatctatcattgaattcatcatttaatttgagatttgggatagaatttgggaaaaaaattgtgaaatatttcaaaaatgtaaaatgatgatttgaaggacaaaatggtatcggaattggatgatttttgtatggttagactcgtgagagtataaggattctagttttgtgaattttgtcaaattgcgagatgtgggcatagggtcgagtttgaccaatttctggaattttgtggtaatttgattattttcgagcgagctttgttcccatagtatattttgatggttttgcactgattttggctagatttggagcatccggaggccgattcgagaggcaaaggcatcgcgggctagagttcggaccggatagaggtgagtaatgattgtaaatgatgtcctgattgtttgaaaccccagattgcaaatcgtaatgctatattgaggcgaggcatacgcttgataacgagcgtggggtcgtgcactattggggattgtgacttggtccgtcccgagtgatgattttaccgcgtatttgactaaaacttatttgctttcatcatgctttgggcttattgccatatttagacttcatgccaactatttgaacccttcggtgatttttattactttttctcactattctaacttattaattgaactcagtcatgttatttcctactgttttactaatcagccatttttactcattttcgagactaaaatgatattttaaattatgttttggactaagaaatactattttactaatacccgaggggcttatgagtatttttgagtgagtaaggccgagggcctagttgtgatgaacactgatactgatttgaggcctagggcctgagatatgtacgccacgaggtggcttgttgatattttttatgagcccgagggcctgagatatatataggccacgatgtggcttgatttatattaggtctagggtctagatatgatactacgagatggcttgatattacgcttgggttgtaagggccccctcccggagtctgtacaccccaatgattgcgggtacccattgtgatgtgagagtgagcccgaggggctgatattgttttgagagtgagcccgagggctgatactgttctgagagtgagcccgagaggctgatattattctgagagtgagcccgagggtctggtattgttcggagatattgccagaggggaggaaatgttgacattgtgcccgaggggcgaatctttatgtgtttatctttcatatttacttaccattttaaatgttaaactacgatttttgtgtccgaggggtgaatttctgtgcttatctgcactaactattgtgcattcatttgcgtaattgttgaaaaggatattttcaaagaagtttaaactgagaaaagatctttctaagagattttacagcttcactgctttctcgctggtttttggactgcttttatacagcatcatgattagctttacgtgatttcttactgctcagtttttatttacatttgttactcactaagttggagtactcactttactcctttcaccttgtgtgcagattcatgtatttatacacccggtagttggttttggttgattggaggcagagttctcggagtatagcaaggtagctaccggcattcgcagcaccgcttttctcactctttacttcattctgtacccaatatattcagttttatttttgaattgtatttatacttgtgacgacccaaagggtcatcaccggtcgttttcctttttccgtacttccgaggccttgaaaacctcacttttagttgcctcgaattgcgtgtgtagtccgggcgcgtagccggaaagcttatatgttaaattctatgaaggttgctaaaatttggcttaaaatgattaaagctaacattggtcatcattttggataaacggacccggacccatgatgtgacggtcccggagggtccatagaaaaatatgggactcgggcgtgtgcccggaatcaaaatccgaggtcccgagcccgagaaataaatttttaagagaaattatttttctgaaattaatatggaaattttaaatgaaatcggattagaaagtattggtgtcaggctcgtattttggttccggcacccggtacaggtcttatatgttgtttaagacatttttgtgtaagttggtcaaaatcgaacgttattagacgtgtttcagacctaaaactctaagtttgaaagtttaagaactttgatgaaaaagtgtcgattttgaggtttgattcctcgtgtatgatgttattttggcaatttgatcgcatggttgagttcgtaggatgttgtcgagttagtgtgtatgtatggttaggagccccaagggctcgagagtgtttcagatgtgtgttggagtgggtttgaacttagaagttgcagaaaatatgatgtctgttgtcgcccagttccttgtgctatgcgatcgcattgcttgtgcgcgatcgcattgtgcaagttttcagaggttcacatttactctatgcgatcgcattgggttattttgggaatcctatttttgctctaaccgatctcaatgccttagcacggcttccttaaaagtcccactatgcgatcgcacttcccttttgcgattgcagagcactgtccccctctactcaatgcgatcgcactccttgtccacgatcgcataggccaatttttgcccagttattattaaattctagaatcagtccattgcggtatttttcataaaaacactcgaacctcttcttctccaaggttcccaagcgtccattgaagccccctttcaccaagactttgtgggttagtaaatcttaactagtttctttcattttccatcaatatctattgaaatcctagacctaaatcatgtaattttggggaggaattgggcggaatgggtagagttagggcttttcaattttctttgatttagacctcgttttggggtcgaatttgaaaacaaattgtatattcgagctcgtgggggaatgggtgacatggaattggttcgaacctcgggttttgaccaagcgggggtcgatttttgaattttgggaagaaaatttagaaatccatatttagccattgggtttagtttgtttagctattattgatattataaagtcattatttcatagatttggttgaggttgagccggattcgagggggaaagttgttattgtggattgattcggtcgtggaagtttgaggtaagtgttcgatctaacttttgcttgagggaataggattagagtattgcttgctaattgctaaatgtcgagtacggtgtatagtcatggtgatgagtatctatacactggtatctagcatgaccgtgagtccttatttgtgcttacacggattttgttgtgactcttcctttgtttaattgatgacttccataatatgtgaagattatgagaaggaattatgatttgtaagctccttggagcattggctcgaatgatgacatgattattgagtaagaaatgaacaaaagagaaagagatgtaattattcccttgccgggctgttctagtatgttgattatctcccttgccgggacgtgtaagttattgttgttgctcccttgccgggatttaactattacttgtgttctcccttgctaggatagttgaattgatatcttgttcccttttcgggaaaccattgtattgccttgtaccattaccattgctaggctagaatatgaaatgggatcgtgtggcacgccgaccatttatatagtatgaaatgggatcgtgtggcatgccgaccgcttatatattataaaatgggatcgtgtggcacgccgaccacttatacattttgaaataggatcgtgttgcacgcctgcaacaagaggaaattgaaataagtgaaaatgacttatggtccccttgttctgtgttagaaggaatcagttgtagtttctttacttatcccagctattctgttattatctgctattcccacaagcatgtccccatcccagtttaaactgtttattttctgatgttatttcgttgtacttgcatatatatatatatatatatatatatatatatatatatatatatatatatatatatatatatatatatatatatatatatatctgcacaggtttgtttggtagtcctgtctagcctcgtcactacttcgccggggttaggccaggcacttaccagcacatggggtcggatgtgctaatgctacactctgtgcatctttttgcacagattatggagccggagcatcctttggatcacagtaggagcatctgggagctgacttcaatccagggacattcgaggtagccttgccgacgtccgcaggcctggagtcccttcctattttatttagtttgttattctaatgacaaaaaaacaatactatatttttatttagactttgtatatagcattctctagacgttcgtgagttagtgactccagatctaggtagagttgtattggattttgcatggtttttgctttattttgattttaatatttccgcttctctattaaatgtttcgtttctcgttatattgttgatgttgttaaaagaagtacttaattaattggattacctaggtcctaatagtaggcgccatcacgactctcgatggtgggaaattcggatcgtgacaatactctaatagatgctcgtgacttgtgacaccccggtatcgggctgtgttttgggttgttttatgcacattataaaaatcctttgcttagttgttgttatctattcatacttatactatttattaatatttaactattttgaaaaggcgaaatgggttagttggttggccttgtcttcacgagagtcgccatcaccaccggattggggtttgggtcgtgacattttgagacaaggacttcatctagcatcttgaggtaagtgtctgctacctatttctagtttaatatcattatcttaggtagattaaacactagtattatggtgaaatcatggggttagagcaacaacctaggggtttaataaaatttagatttaaccacgaaatttgttatggaataaattataaataatatattattgatccttaggttgtagagaataacttccttcaaaaaatctcggaatccgggcacgtggacccggggtcggaatttaggaaacttgtgttaatggtctgcttaaatagttagaattcgatcttgtgggtctatattaactagttcttactacgtttaactagtttgggattgtttggctccgaattaagggtttggactcgttcttggtaatgggaagtgcattttggagcgaggtgagtcttctttctaaccttataagagggaattgtcctcataggtataataattgtattaattatcattttatgcgtgtgacgactgaaagggtcatcacctgctttttttcctttttccgaggccttgaaaaccatatttttagttgcatcaatttgcgtgcccaatccgggcgcatagccggaaagcttatatgttaaattttgtgaacattgttgaaatttggtgttaaaatgagtaaagttgactttggccaatattttggataaacagaccaggatccgtaatttgacgatttcggagggtccgtagaaaaatatgggactcgggcgcatgcccggaatcgaaattcgaggtcccgagaccgagaaatgaatttttaaaaagaaattatttttctgaaattaatatggaaatttaaaatgaaaatggattagaacgtgttggtatcgggccgtattttggttctggcacccggtacaggtcttatatgtgatttaagacgtttttgtgaaatgtggttgaaatcggacgtcatttgacatgtttcggacctaaatctctaaaaatggaagttgatgaagtttgatgaaaaagtaatgattttgaggtttgattcctcattttttatattattttggcgatttgatcgcacagttaagttcgtaggatttggttgagatagtgtgtgtggttggttaggagccgcgagggctcggggtttcttcgaaggtgttcgtggtaattttgaaacttagaaatgttgcagaaaattctgcaataagtgcccagtgattctcttcttcgcgttcgcgaaacttcagtgttttccttcaccgagttcgcgatacagtcctcgcattcgcatagcattagttgactctgggggaagcattccacttcgcgttcggatccaaccgttcgcgaacgcatagcattgcaaacccctttatcgcgttcgcgtgaccttcaacgcgtttgtatagcacaaacttcggaccccagtaccttccttctacgcttttgcttttggctccacgcgttcgtgatgcttacccagtttacccttcgcgaacgcggcccccttcctgcgaacacgaagggaaatttcgcccagtgattttaaatgtccaaaacagaacagtgacgggatttttcaccccaaaaaacacaaggacccttcttctccacagaccctaggcaatttctagagttcttcttcaccaaagcttcttgggtaagtattgtttaacttgtttccttcatttcccatcatcatttatcaaattcctaggctcaaatcatgtaatctagggttgaaatttggggaaattggtagagttagggcttttcaacattcttcgatttagacctcatttgggggtcgaatttgaaaacaaattgtatatttgggctcttgggggaatgggtgatatgaatttggttcgaatctcgtgttttgaccaatcgggcccggggtcgagtttttgaattttttgaagaaaggttgggaatatatatttaggcattgggttggatttgtttagctattattgatattttaaggtcgttattttatagatttgattgagttggagctgaattcgagaaggaaagtggtcgtggtggattgatttagccgtgaaagttgaggtaagtgtttggtctaactttggcttgagggaatatgagtaaagtcttgtttactaattgctaattgtcgagaacggtgtataggcatggtgacaagtatctatacattagtgtctagcatgacaaagagtcctaaattgctaaattgttgtattcttaattgatgcctatgagaacttgattagaaatctttaaaactgagcaagtaattgttatgaacgagtattgccattaatggtgttaagtagaaattgaatgagtttggttatagctggatttcccttgccaggatagttgatttgacattttgttcccttgttgggaaatcactatattattttgtacccttgccgggtaaatcattatgttatcttgttcccttattaggaattttttcttgaaagattgtattgcaaatgaaattgaagcgagtggtatgcctaccacgtgatattataaaatgggagcgagtggtacgcctaccacgtgatattatgaaaagggagtgagcggtacgcctaccacgtaatattatgaaatgggagctagtggtacgcctaccacgtgatattatagaatgggagcgagtgatatgcctaccacgtgatattatgcaatgggagcgagtggtaagcctaccacgtgatatgaggaaatgggatcgtgttgcacgcctgcaacaagaggaaattgaaagaagtgaaagtcgtttgttttcccttattctatgttagaagaaaccagatgtagtttcttttattattcttgatattatggttttatctgctatccccataagcatgttcccctcccagctttatttgtttactttccgctgttatttcgttgtacttgtatatatatatatatatatctgcacaagtttatttgttagtccgatctagcctcgtcactacttcgccggggttaggccaggcacttaccagcacatggggtcggttgtgctgatgctatgctctgtgcatctttttgtacagatcacggagccggaggagcttttggatagtagtaggagatttgggagctgactttagtccagagacaccgaggtagccttgctgacgtacgcaagcccgaagtctcttctatccttactttagtttgttttcctttgtatcggaacaaacagaattatatttttttcagtcattgtatttagcattctctagacgttcgtgagtttgtgatacagttcttgggtagagttgtattggattttccgcattgttttcagtttatttatatttaagtctttcacttttctattaaatgtttcgtttttttaataatgtcgatgtttggtaaaagaggaataaataattggcttacctagctcctgatagtaggagccatcacgactcccgagggtgggaaatccgggtcgtgacaagtttgtatcagagcactaggtctcataggtctcacaagtcacggacaaactcggtagagtctgagggatcgatacggagacgtctgtatttatcccaaaggctaaagagttaggaaaaatttcacttttgttctttcttgtcgtgcgattctctttcttgaaggattgtccttctacactgttctttcgcaaatggcgagaacacgtgcttccacttctaccgcgcagcagcccgagcccccagtagtagctcctattaggggtagagggcgaggccgtgccagaggccgaggcaggggaagagctaagtcccgagtagcagtcccataggtggagccttatattgattatgacgaggaggttgcagctctagcagctccggtgggcccagctcaggtcccggaagggttcatagccaccctagttctttagagcgctttggtcagatggtaggctttgtggagtgcgtcactagagcgggtttgcttccagtagcaccagccacttctcaggctggatgaggggttgagactcccgctacacatactccggagtaggtagctcctcaggctcaggttccagtggtgcagccaactgtggcagtttagccaggtatagcggctcagaccggcgatggtgcggctataaccgtcgatgctctgtggatattggattgattcaccaagctcttcactaccacatacaacggtacttctttagaggatccccaggattttttatatagctgccatgaggttcttcggactatgggtattgtggagacctatggggtcgactttgccacctttcgcctagcaggatccgccaagacttggtggagggactattgtttagccagaccagcagggtcaccatctttgactttggaccagtttgcagagttgtttttggagaagtttctcccagttactcagcgagaggctcttcgtaggaagttcaagtgcctccatcaaagctctatgatagtgactcagtatgagtcctggttcattgatcaagctcgccatgctattgttatactcctcactgagagagagagagagagagaaggtgtggaggtttattgatggtttgattcagccgatccgtctccagatggctgtgggagccggaagtgagatttctttttaggaggcggccaatgcggcccgcaagatagagatggatcttgcacagggaggtggtcatgggtcagataagaggccccgtcatgcaggtagattcagtggtacctcgtctggaggtagagattcttatggttaaggccatcctccgaggccctttcagtccgccttacaggtatcacatggtacttcaggtggtcgtggttctcagccgcattattctcaccagcatccttacagttcaccatcaacacctattagtgcaccaccactttgttattcccagcaaccgagggcttgtttcacgttttgcgatatgaggcacattgctaggtattaccctcgagcttctggcatctctcatcatcagagttctcgtgctaactagaggttccacagcctgcccagccagctaaaggtgggggtagaggtcatagaggtagagttaaaggtcatagaggtagagctcaaactgccaaaggtagaggccagccagtagccgatcgtcccagggatgtggttcagggagatggggcacaaccccggtgttatgctcatccagccaggctagaggctgagtcgtcagatattgtcattacaggtactattatggtctgtgatagagatgctccagtgctatttgaccctaggtctatgtattcatatgtgtcgtcctattttgcatcatacttagtcatgcctagtgatgctttgagtattcctgtttatgtatctacaccggtgggtgattctatagtggtcgaccgagttcatcgttcctatgttgtggtgtttaggggtcttgagagccgtgttgatttgttgctcttagatatggtggattttgacattatattagggatggattggctgtccccgtatcatgctatcttggattgccatgccaagaccatgaccttggctttgctagatttgcctcgtttggtgtggagagggaccccgagtcataccacccgcagtgttatctcatatgtgaagtctcgacgcatggtcgagaaggggtgtttagcttatctggcatatgttcgcgattccaacatagaggttccttctattggttcgggagttccccgaggttttccttttagacatgccaggtatgccgcccgatagggatatcgacttttgtattgatctggctccgggcattcagcccatttccattctgccgtatagcatggcactgaaagagttgaaagagttaaaggatcagttacaggatttgcttgagatgggtttcattagatccagcatttcaccttggggtgcgctggtgttatttgtgaagaaaaaggatggttcgatgaggatgtgcattgattatcggcatttgaacaaagtgacgattaagtcaagtattcactgccgaggattgacgatttgttcgaccagcttctgagtgcaaaggtgctttcaaagatagacttgagatctggctaccatcagctgaggattagggcgtctgatgtccctaagacagtattccgcactcggtatgtgcattatgagttcttggtcatctcatttgggtttaccaatgccccagtagcgtttatggagttgatgaaccgagtgttcattccttatttggacttgttcatgatagtatttattgatgatattctcatatactcctgcagccaagaagagcacgagcagcacctcagagtgattttcagactctgaaggatagccagttatatgctatgttcttgaagtgtgagttctagttgagttcggttgcatttctcgatcacgtcgtatcagcagagggtattcaggtggacccgaagaagattgaggcagtcaagaactggcctcgaccaccttcagctatagagaattgaagtttcttggggttagcaggctactgccatcgattcgtggaggggttctcgtctattgcagcctcgatgaccaggttcaccagataggtgcctagtttagatggtcagatgagtgtaaggcgagctttcagaagctcaagacagctctaactatggcagcggtattggttttacccacaggttcagggccttatacagtctattgtgatgtttcctgtattgggcttggtacaatattgatgcagggcggtagagtcattgcctatgcttcgaggcagttgaagatccacgagaagaattatctggttcatgatcttgagttggcagccatcattcatgctttgaagatttggaggcattatctatatggtgtgacgtgtgaggtgtacactgatcacaagagtcttcagtatttgttcaagcaaaaggagttgaatttgaggcagagaaggtggttggagttgttgaaagattatgatgttactatcttgtatcacccggggaaggccaatgtggtggccgatgcattgagtagaaagtcctccaacatgggtagccttgcttatattccgatcagccatagatcgcttgctttggatgttcaggccttgtccaatcgacttttgaggatggatatttctgagcctagtagagtgttagcttgtacggttgctcgttcttcattattgaagcgtatccgtgatcgacagtttgatgatccccatttgtgtgtcctgagagacatggtgcagtgtgaaggtgccaagaaggtgaccttagatgatgatggtgttttgagatagtagaggcgagtttgtttgcccaatattgatgggattcgagagttgatcttatcggaggcccatagttctcggtattgtattcacccgggcgccgcgaagatgtatcaagatctgaggcagcactattggtggcgtagaatgaagaaatatatatttgcatatgtggctcgatgtttgaactgtcaggaggttaagtatgagcatcagaggcctggtggattgttttagaggattgagcttcccgagtggaaatgggagaggattaccatggatttcgttactggacttccgatgactcggaagaagttcgatgctgtttgggtcattgttgataggctaaccaagtcagcgcatttgttcttgttccagccacctattcatccaagagattagctgagatctacatcagggagattgttcgccatcatggggtgccggtatctatcattttggaccagggtacgcattttacctcgcacttctagaaagcggttcagcgagagttgggaacccaggttgagttgagtacatcatttcatccccagaaggacggtaagtccgagaggactattcagatctaagaggatatgctccgagactgtgttattgattttaaaggctcgtgggaccaatttttgcctttagcagagttcgcctacaacaacagctaccagtccagcatttagattgctccatatgaggcattgtatggtaggcgatgtcggtctccagttagatggtttgagccgggagaggctcgattattgggtacggatctggttcaggaggccttggataaggtccggattattcaggataggcttcgtacaactcagtccaagcagaagagttatgtagaccgcaaggttcgagatgttgcttttatggttggtgagcgagtattgctccgtgtgtcgcctatgaagggcgtgatgagattcgggaagaagggcaagctaagccctaggttcattggtccatttgagattctcgatcgtgtaggagaggtggcttattgacttgccttgcctcctagtttgtctaccgtgcatccagtgttttaggtgtctatgctccggaagtatcacagcaatccatcccacgtgttagatttcagcactgtccaattggataaggatcctgtcctatgaggaggagccggtggctattctagaccggcaggttcgacagttgaggtcgaagagttttccttcagtacatgttcagtggagaggtcagcctcctaaggcatcgacctgagagtccgagtccgatatatggagctgttatcctcatctatttcccgattcaggtacttctttcttttgtccgttcgaggacgaatggttgttttagaggtggagaatgtgacgacccaaagggtcatcgcatgcttttctctctttttccgtgcttccaaggacatgaaaacctcatttttagttgcatcgatttgtgtgcccagtccgggcacgtaactggaaagcttatatgttaaattctgtgaaaatagttgaaatttggtgttaaaatgagtaaagttgatgtcacgacccaaatcccggtcgcgatggcgcccggccgtaaggctaggcaagcccgaccacaatacccataaactcagatgaaagatacgaaagagaaaataaactcagaatataccagatctaggtaccaagacagacggaacaaatactgaataacaataacaactccctaggaaccggtgtcacaagtctgagcctctaggatatagatcaatccgatacataactgtttagaatagggaatacaaaagtaatactggaaataaagatagagggaaggagggtcgatggctgcgaacgccgtgcagctacctcaacgctccgaactgctgatgtctgaaaagcttcaggatctaatccgcctgagcataccctggatctgcacacatggtgcagggagtaatgtgagtactccgacccagtgagtaataacagtaaataaagtccgaagataagaaaacacagaaatacacaaggcaagctaaagaacaatatatgtaacaatatctgaatctgagcaaaactgaacaacaagtaagatgcaaatgcaggaatgctatgccatgcaaatgccggtactctccagtacccatcatttaacgtcgacggcgctcactgggggtgtatacagactccggaggggctcctacagcccaagcgcaataatcagccatctcgtggtggcaaaatacgacacagtgtccatgttaccactggtccaaacaataccccggtcagtccatgttaccctgaccgctcatacgacacagtgtccatattaccactggtccaaacaataacccggtcagtccatgttaccctgaccgctcaaacgacacagtgtccgtattaccactggtccaatcaccgctacggcgtgcagccgagccaactatgcatgtgtatatgaatgcaatacaatgcgatgcaatgcgtatgacatacaatccaatacctgccgtggtgtacagtccgagccaccaaaatcagtccagaaaatatgtctcacaagccacttgggcagttataagtcatgatcctcagccgaaatacattttaaaagatataatgtgagtttgaacatttgaaatacggctgggttttgaaaacaatgctttaagaagccatggactgatatgaatgatatgcaatcatgataaacaataatatccactctcgaagagtatcacaggtcggcactaggccccaaacacggcatatagcccaatgataatcataacagtacgcgtatcatacgccaatatagtataaaatctcactcgggatggaccatgtcacaatccccatcaacatccgactccgcacatatccaggagtgcgagtcacgcctcaatatagcgttacgatgtgaaagtccggggtttcaaaccctcagacagcatttactagcattactcacctcgaaccggcgaacactcaagcccgcgacgcctttgcctctcaatccggcctcctcgcgcgtcgaatctagccaaaagcagagcgaatacatcacaataagcaaatgggacaatacccaatcgaaagcaaccgagaaatagcaaaaatctcgaaactagcaaaacccgagccccgggcccgcttctcgaaaaattatgaaacctacctcttcggaatcctcgtctcgccacgagtccgtacatataaagttcatcaaaatcggagtccgattgctcctccaaatcctcaatcttcatttgaaattccaagccctagttcttccccaatttgatttgatttcagaaatttaagggctaaaaccatgattaaatgatgtttttaagtcaagagacttacctccaatcaattccctttgattccctcttcattttgctccacaagctctccaaaatgaccaacaatggaagaaatatgaccaagctcgcggatgaaatgtccatttaaaacccttctgcccagatccgattccttctatgcgatcatggacatgcccctgcgatcgcatagagcaacttctgctgcctcacttttcctcttacgcgatcgcaatcttgcctatgcgatcgctatgaccagcctctcaaccttacgcgatcgcactcccagccatgcggtcgcagagaactataaaccccaactacgcgatcgcactcccccttacgcgatcgcagagatcaaaatttcggaacccatcccagccttctatgcgatcgcaatgccagacctgcgatcgcatagagcaaacatctgcaacacctgaagctcaaaaatctgctgcacttttcaactttgaaatttcccgacaaccatccgaaatcaccccgaggcccccgggacctcaaccaaaagcaccaacatgacttgttacttcattcaaacttgctcggatcataaaaacgctatcattaacatcaaaaccatcaaaaatccttaaattcacttctagttaaacttaaactttcaaatttcatatccggtgccgaaactacccaaacgatgtccgaatgacctgaaaatttgcggacatatccaaaatcgcctaacgaagctaatgcaactctcggaatttcattccgaccctcgggtcaaattctcacctaccaatcggattcttccaactttctaacttcgccaaatctagataactttcactcccgaactccgaattcacttccgctttcgccaacaagtcacaaatcaacccccgaaactagtcgagccatcggaaatccgttccgagccctctagcccataagtcaacttttggtcaaccttaccaattcaagcttctcttaaatagactcctcaacctatttctatccaattccaacccaaaccaattctaacttaccgaatacacaaaatcacacacggggaaacatatgacggggataacgggctgaaatataagaaaagacgggtcgggtcattacagttgactttggtaaatattttgggaaacgaacccggatcctttatttaacggtcccagagggtccgtacaaaaatatgggactcgagcgtatgcccgaaattgaaattcgaggtcccgagcatgagtaatgaatttttaaaaagaaatggttttttctgaaattaatatggaaattgaaatgagaatggattagaatgcgttggtatcggaccgtattttggttccgacgcccgttacaagtcttatatgtgttgtaagatgtttctgtgaaacttggttgaagtcggacgtcatttgacgtgtttcaggcctaaatctctaaaaatggaagttgatgaagtttgataaaaaagtgatgattttgaggtttgattcctcattttttatgttattttggcgatttgatcgcacggttaagttcctaggatgtggttgagataatgtgtgtggttggtaggagactcgagggctcaagggtggtttcgaaggtgttcggggtgattttgaaacttagaaatgttgcagaaaattctgtaataagtgcccagtgattcccttcttcgcgttcgcgttatccccttcacgttcgcgaagcttcaatgttttatttcaccgcattcgcgatacagtcctcgtgttcgcatagcattaattgaccctggggtaaactttccacttcttgttcgcatccaaccattcgcgaatgcatagcattgcaaatcccttcatcgcgttcgcgtggccttcaacatattcgcatagcacaaacttcggaccccagtaccttccttctacgcgttcacgcttggctccacattttcgcgatgcttacccagtttacccttcgtgaatgcggcccccttcccgcgagcgcaaagggcaatttcgcccagtgattttaaatgtccaaattagaacagtgacgagatttttcacccgaaaaacccacagtcctttcttctccacagcccctaggcgatttctagagctcttcttcaccaaagcttcttggataagtattgtttaacttgtttccttaattttccttcatcatttatcaaattcctaggcttaaatcatgtaatctagggttgaaattcggggaaatgggtagagttagggcttttcaatattcttcgatttagacctcgttttggggtcgaatttcaaaacaaattgtatattcgggctcgtggaggaatgggtgatatgaatttggttcgaaccccgtgttatgacaaagcgggcccggggtcgatttttggaattttcggaagaaaggttgggaatctatatttaggtattgggtttgatttgtttagctattattgacattttaaggttgttatttcattgatttgattgatttggagcagaattcgagagggaaagtggtcgttgtggattgatttagccgtggaagttgaagtaagtgtttgttctaactctggcttgagggataggagtagagtcttgtttgctaattgataattgtcgagtacggtgtataggcatggtgacgagtatctatacactagtgtctagcatgaccgtgagtcctaaattgctaaattggtgtattcttaattgatgcctatgagaactttattagaaatctttaaaactgagcaagtaattgttatgaacgagtattggcattaatggtgttaagtagaaattgaatgaatttggttatagctggatctcctttgtcgggatagttgatttgacattttgttcccttgccgggaaatcattatattaatttgtacccttgccgggtaaatcgttatgttatcttgttctcttattgggattttttctagaaagagtgtattggaaatgaaatgggagcaagtggtacgcctaccacgtgatattatgaaatgggagcgagtggtatgcttaccacgtgttattatgaaatgggagcgagtggtacgcctaccacgtgatattatgaaataggagatagtggtacgcctaccacttgatattattaaatgggagcaagtggtacacctaccacgtgatattatgaaatgggagcgagtggtacactgaccacgtgatatgagaaaatgggatcgtgttgcacgcctgcaacaagaggaaattaaaacaagtgaaagtggtttgttttcccttattctttgttacaaaaatcagatgtagtttcttttattattcctgatattttatttttatctgctatccccataatcatgttccccctccaagctttaattgtttacttttcgctgttatttcattgtacttgtgtatatatatctggaccggtttgttgtccggtccagcctcgtcactacttcgccggggttaggacaagcacttaccagcacatggggtcggttgtgctgatgctacactctgtgcatttttttgcatagatcatagagttggagcagcttttggacaacagtaggagatttgggagctgagtttagtctagagacaccgaggtacccttgatgacgtccgcaggcccagagtctcttctatccttactttagtttgttttcctttgtaccggaataaacagaattatgtttttattcagacattgtgtttagcattctctagacgttcgtgagtttgtgactccagttcttggtagatttgtattggattttccacattgctttcagtttatttatatttaagacttctgcttttctattaaatgtttcgttgtttttaataatgtcgatgtttgataaaagaggaataaataattggcatgcctagctcctgatagtaggcgccatcacaacttccgagggtggaaaatctgggtcgtgacaatacgggggctacgtacgcactaggtgaccagagtccgtgcgtagcggctattatgttaagtctaggtagtctaggacccaaaagcatgccctatgttatattcttgtaacttattgataaattcggattcgtataatttattttgattaaggtaaatgcaactagtaagggaatcttatcctgttgggtcctttaaaaagaatttgggaatttctgtgaattaactactcctcatatatacattattttatgtttgttgaagattttaattattttttaccgcgtcgcatgtgtgattcgcgagcggggtaacatatgcatctatggttcgaaccgttcgaccctcggcaatgtacaatttacttttatgttggatcgggccgtacgtccctcagtgttatttgtgcgtgtttttcttagcattctctccgtagacttgactttatatctgcttaatatatagatgaatacccatgttaatatttggaaaaagaactgttattccatgtttattaatactaataacttatgttattcttgcttattatagcttcttctcatattatttgaccctagtaagtatcgagtcgagctctcgtctttacttcttggagattcgacgggatacttactgggtacatattttttatgtactcatactacacttctatacttaatcgcacaagatctgaggcaggtgtatctggctatctgtctggagcgcatccttgagcggacccgcgacttctaatgtgacccgcttcccttccatgccgttcaacagcctaaagaagtctttcttttgctgtctattctgtttcggacagtaggatagattgattcttttgtatattttactagttgtccacagcttgtgataccaggtcttggcacccacattagtagactatatcatttggggttgtatgattattatgactttattaatcatttctggtttttgtttcaacttaaataattatttcaactatttttgggtaattgtaaaagagagttatttggtattgttccacgttggtttgcccgcaatggtgttgggcgccatcatggcctaatatggaaatgggtcgtgacaacatagtattagagcactaggtttacgtaggtctcaaaaggcatgggcaaacctaatagtgtcttatagatcggtacgaagacgtctgtatttatcttcgagaggctataggttattaggaaagactactctttattcatttcctatcgtgcagtggttggtatacaaaatttcccacttatattctcttacagatggcgaggacacgcacgactgatgttctgaacccgggaagagctgctccccccgttgcttgaggctgaggcggaggtcgggggagggcaccggcccgtggtaggggatgagggtgtcccagagttattgcagtagcaccaccagcagatcatgtgggagatcctactatcgaggagcagggcgaggttcccgcagttgagtgtaccctgacaaactttatgacaacaccaggatttcaggaggtcatgggtcgtatgctacagttcatggattatatgactcaggctggtttatttccagtagatccagctacctcataggcagagggggagcatagatctcaactgctcaggctccaggacatagaggtgcggtgtatcagactccgggtgcactacccgcagatggggcccagccaattactgcagtggcgccccagctcagaccagctgcggacggtaacccgcaaaagttattggatagatggactaggcttcaccctcctatctttgggggtgagcgatatgaggatggccaggacttcatcgacaggtgcagggacagactccacaatatgaggatattggagtcacatggagttgactttactatttttcagctggagggcaggccccatagatggtggcagtcctatattcttggaaggccagaaggttctcctcccatcaattggggtcagttcacacagttattcttggatcagtacattccaccctctgagagggaaaagcaacggtatcggtttaagcatcttgagcagggtcatatgtcggtgacccattatgaggcgaggttctctgagttgtctcgacatgcattcatgatacttcctacatattcagagagagtgcggagattttttgcggggttacaccccactatacgagggggcatggcccgagaggtggagatgggtactgagtatcagctagtgattgagattgctcgcggaattgaggggcagagagcagatgtagcaggataagagggctagacttctaggagagttcagaagtgcctcagctagaggtagaggtcacttcgggaggggtcaaccgatcaagcctccgtattcagcaccaccacccctccccgaggatccctagtgaggccttacttcagtgccatgccatagagttcatatcactcaccagctatccagggttcttctagtgctcatttcagtgccatgctagagagttcatattgcccaccaaccatctaggggtctttcagtgggtattcgggtcaacagactcagacttcagggtagcaggctatggtaccgagagtatgctacgagtgtggagatccgtgaagaggacctgcctcaggtttcagcacaaggtagtgtagcagggtcagcagcccataatttcagcaccagctgcccagccacctagaggttaagggcaggctggtaaaggccttcctagaggtagaggtcaggtagggagaggtcatctagctactgcttagtcaggtgaaggccagccagccgacgctctagccagattctatgccattccgactaggccagatacattggcctcaaatgtcatcatcataggtattatttctatcggtggtagagatgcttcggtattatttgatccagggtctacttattcatgtgtatcatccttttttgttcgtttcctagttatttctcctgagcctttgggcactcctgttcatgtgttcactcatgtgggtgattctgtagttgtggaatggatccaccggtcctatgtggtcacattcagtggtttcgggagtagaccagatctaatgttgcttgatatgagcgattttgaggtcttcctgggcatggattaattatctctgtatcatgccatcctagattgtcatgccaagattgtttcactagtgatgctaggttagccgaggttgaagtggaagggttccacaagatatacctagttggattatttccttcctgaaggctcgacatatggtcgagaaggggtgcttggcttatctgcttatgttcgggacaccactgtagagtctctgacgattgattctatcctagtagttcgagagttcgtcgatgtatttccttttaatctccctggcatgccatcagatcgtggtattgatttggctccaagcacccagcctatatctatcccaccttaccatatggcttctaaggagttgaaggagcagcttgagaagtttttgacaaaggggtttgttaggtccagtgtatcgccttggggtgcaccagtgttatttgtgaagaagaaggatgggactatgcagatgtgcattgattaccgccagttgaacaaagtcaccgtcaaaaacaagtatatgttgccttgtatcgatgatttgtttgaccagtttcacggtgccagggtgttctctaagatcgacttgaggtaagggtataatcagctgaagattcgggacttccgaagactgcattctggactagatatggccattatgagtttctggtgatgtcctttggtttgactaatgccctagcagcattcatggatttgatgaatagggtgtccattccttaaattgattcatttttcatcgtcttcattgatgacatcttgatatattcccgtagcctgggggagcatgaacagtatttgaaagtagtgcttcagaccttacgagagcagaagctatatgctaagttctccgagtgcgagttttggctagagttagtggcattcttgggacatgttgtgtctggagatggtattaaggtggatcccaagaaaattgaggcagttcagagttggccacatcctacttcagtgatcgagatcgggagtttcttagggctatcaggttattactggcgattcgtgcagggcttttcatttattgcatcacctttgactagattgacccagaaaggtgctccattccgttggtccgatgattgaggggagagcttccagacgctcaagacaactttgactacaacaccatctcttgtgtttccttctagtttagggatgtatgcggtatattgcgacgcttcatgcgttggtttagggtgtgtattgatgtaggaggggcggtttattgcatatgcatcgcgtcagctgaaagttcatgagaagaattatcctgtgcacgatctacagttggcagcaattgttcatgctcttaagatataaaggcattatctgtatgggttttcatgtgaggtttataccgaccatcgcagcttacaacatttgttcaagcagagagatcttaatttgaggcagtgcaggtggcttaagttactgaaggattatgatatcaccattctttatcatccgggcaaggcaaatatggtcgcggatgccttaagtagaaaggcagaaagtatgggtagtttggcattcattccaacagaggagaggccactagctttggacatccagtccttagctaacagacttgtgagtttggacatttcagagcccagccgagttcttgcgtgtgtggttgctcagtcttcactattggggcagatcaaggctcgacagttcgatgatccacatttggtggttctcagagagacgacacttcatgggggtgccaaggaggtttctattggcaaggattgtgttttgtgactccagggtcgtctatgtgcctaatattgatagtctgagggagaggattctagaagaggctcacagttagcggtatacattcatctgggtgctacaaagatgtatcgtgacttaagacaacattactggtggtggagaatgaagaaagacatagtggagtaaatagcgagatgtttgaattgccagctggtcaagtatgaacaccagagtccggtcggcctactttagcagattcctatcccagagtggaagtgggagcgcatcaccatggattttgaaatttggttgtcgtagactttgcgaaagtttgattcagtatgggtcattgtggataggttgaccaagtcggctcacttcatttcagtggcgactacttatacagcgaagaggtatgctcagatttatattcgcgagatagtccggttgcacggtgtgtctgtttccatcatatcatacgaaggccctcagttcaattcccatttctggagagccgttcagagtgagttggggacccgtgtagagcttagcacaacatttcatcctcagaccgatgggcagtcggagcggacagttcaaatttaagaggatatgcttagagcatgtgtgattgacttttgagggcagtaggatcagttctttccattaacgaagtttgcgtacaacgacaactatcaatcaagcatagagaaggatccatacgaggctttatatggtcgacgttgtcgttcttctatcgggtagtttgagcccggtgaggctaagttatatggtacagattggtacatgacgcaatggataaggaaaagttgattcaggaaaggcttcgcacatctcagtccaaacagaagagttacgtggatcagaaggcgcgtgatgtatcatttattgttggcgagaagattttcttgaaagtctcgttaatgaagggcattatgaggttcgggaagaagggcaagttgagcccaaggtttattggtccctttgaggtgttgaggcgagttggggaggttgcctatgagtttgctttaccccccagcttatcgggggttcatccagtttttcatgtatcgatacttcggaagtatcacgccgacctatcacatgtattagacatcagtactatccagctggatgagagtttgggctatgaggaggaaccacttgccattattgatagacaaaattgccagttgtaagaggatttctttggtgagggtccagtggaagggacaaccagtcgaggaggcgacctgggagtccaaggaggacatgcagagcagatatccccatttattcagtagcttaggtacttttcaatgtgcgttcgaggacgaacgtttgtgtaagaggtggagaatgtatcgatctgaccggtcatttttccttttagaatctcattcccttaaataaaacttcccgtggttgctttagctaatttatgacatgcgaggatggttggttcgggtattggaagagttttgagtgaaatatgtccatttgattccttaggattctcttaaaaggctaagtttgacgttggtcaacattttgagtaaacagatccggatacatgatttgacggtcccaaaggtccgtgtgaaaatatgggatctgggcgtatgtccggaatagaattccaagattcctatcccgagcaacgaatttttatttaaaatagggatagagggagaggccagggcccgcggactcctgcaggtctaccttgggtctccgagcggactgaatgaagtcctccgactactatccgaaagctgctccggggtatgcgcacagtgcagagtgtagtatcaccacaaccgaccccatgtgctggtaagtgcctagcctaacctcggcgaagtagtgacgaggctaggaccagactaccaataaacttgtgcaacttaaatatatacaacggaaaagaaaatgcagaataacaagtaatgtggtaagggggaaacatgttgtgggggagatatagttctgaataaaaagacatcatgtaaggaatgaaacaaaatcacttggataccaatataaagttaggaatcaataaatccaccacataacccttcgtccttttaatctcatcctcaccaaaacaaatatacatattagaaatgtgcacgacatcacccttcgtgcttttactctctttcctcaccagataatcaatagaatcggcacgaaatagtacatcacacgacacgacatcacccttcgtgctttttcactcttcctcacccaaaaaacaatcacaaacaatgggatgagggaataaataagattataataggaatcccagcaagggaacaacaattaaataattaaatcctggcaagggacaacatcaacaatatcaacatcccggcaagggagataaccaataaagcaataatatctcggcaagggaacaatttaataactctttctcttttcaattttatttcacatctcgctttatcacttgagtcaattctccaaagggttcaataaactcacttactttcacaaatttgtaatatgacttgagccattgctcctcgatattcaaaagccacaattacttccttaacttttcacaacaaatagaaatcacttctaaagcatagattattcaacgaaatcatgaaaataacattatatgactcatggtcatgctagacaccaacatatagatactcgtcaccatgcctatatgttgtactcaataataatcacgtagcaaataggactcgactcctaatccctcaagctaaggttagaccaaacacttacctcaaaatttcacggccaactcaagcctcgaacaccgctttttttttcaaattcggctccaacccaatcgaatctataaataattgacttaataacatcagtaaatgctaaacaatccaattccaatgttcaattataactttccaatcattcttcccaaaatcccaaaaatcgaccccgggctcgcttggtcaaaacacgaggttcgaaccaaaatctgatcacccattcacccacgagcctaaatatataattagttccaaaattcgacccgaaaatgaggtgtaaatcaccattaatcaaaaagccctaactctacccaaatccctaatttctacacttattcacatgatttaagcctagaaatctaattggtgttaatgaaaattaacgaaaacgagtctaagattacctacctatgagtttgtggtgaaatccattttaaaaaatcccccaatttggagttaagatgaagaagttatgaaaatttgaacaattctcgtttttgctattgttttaagtgctgggcgacagtgttcatcgcgttaacgagaacactatcgctatcacgaaggctgccagtaagtggacttacgcgatcacgagtccttccacgcattgacgaagagttgaactccctgataatcgtcgcaaactcaatccgtagaatgagcgggctaggattactaatacccaatagcagtatcggggtcgaaattccgcagggagcttcaaattggagttgagtaaattgtatggcttagaagtatgttaatgcttctaattggacttcaaacatttttggttttgatttaagttctactttctaatatgatcactactatgcaaaactacaattatgctaaattatactaatattagggttttgtaacaagatagaaaggcactagggtcgtgaaacttacctaggcggataattaacgggtatgaaattctaactcgaggatgtcaagtatggggaatatggataaccgttgcactatagcactcgttctcacacctctcggtagagagaacgatttgcccaattgactctctcgagaccaattgggtaggccaatttgcctaagcaactcaaagttcaagtaaggtaattactctctcgagatttaacctattacttgggactaccattatcatgggtccatcccaaatccttgttaggttgagggtgaggcaatagattctctttctccagaagaatcaatacccactaagctttacttagtgtttgaaaacaccaaatctgagtaaaagcatacacacaatccaaatccaaacaaccaactaacatccacaaattaagcctaaacacccattaattacccacactagggttgagtcagaaccctagctaatgggtttagctagacatgatagaactagaaactaaagaaatagtagaagaagaagacataatcattaattaaaagagaaaactaattgattccacgttaaatccacataaaatttcctaaaagatgctaagaatatgtctcacgagcctagctgctcttacagagtatccaaacttaacctaaaaaagtaaaatgttctatttatactacacaataatttccgaacaaaaatgcccctgagggtcagatgcggaccgcacagaagtgacgtgcggccgcctagggtgttttggtcttcacttcatttgctcaggatcaatagatgcggaccgcctaagagtggagcgtggccgcgtaggtcttttcaggcggaccgcacagaaatgatgtgcggccgctcatgaagaaatgctggaatggttggtctctgatcttgctcccacgcggaccgccttcctttgatgtgcggccgcgtgggttatgtgtctgaaagtctgttctctgaacttttgaacaggcggaccgcgcagatatggatgcggcccgcgtgagtcttccttcaaattgtcatctctctgatcctttccaggcggccgtatgccaaaggcaggcggaccgcaatggtcttgtaaaaatgtccaacactctgaatcctcctatgcggtcgcgtgcacactcagtcggactgcacagggccttttagcctccacttttgttaactccttgtcgcttggcaggtttcactccatttttgagcaaatttgtgatctaagtcattttgtcgctcaaacctgcaatcaagcacatctgtaagtgttttgggactaataagaggtcaattaagtgcaaagctaaggcaagaaaggggcataattcatgtacaattcacagttatcaactcccccaaacttaaacctttgcttgtcctcaagcaaataaaatgagacacacccctcaatctaaaacaatccagaaatccctgttttcctagagtaacctcaacaagcttcaattgggacgaacaattgtctccaatgcaaatgaatcattaacaattttaaagctttgcaaacttgcggatcaatcatgacgcaagagcttcaagagttgacacatttcttcatggagctttttctcaagtactttggtcattgtggaacctaaactcgcacatcctcgactctccctaagtgaacctcacctttttgaatatatgcatgcaaatcgaggtggaaaactctctcactcagtcactcagaaagaagagaccctaagtccggctctaagtaccatatgcttgccctttatgtaagtatccactaatgtaggcttttctcgatttaagatcatgaaggactttttaggagtcattgtgaaggcttttgggtctgggttgctcaattgttcaaattggttcactcttcccttgagcgcttcttttgtttctttgttgcacactttcatgattcaaatatgcctttttcctcttcaaagggggtagagagatatgatgtcactctgtcttttgcatttcaaaccttttattctccttttttctactttttcaacctttttcactttattgatgtacttttgattccctttttgattcttattctctttttgacttcctttttgtctttttctctttttcattgccttcctttctcctttgcttttgtacctaaccacatgatttcttttcttgtctctccccccaaacttagacatttgtcactactcaagggaagatttgggtgccaagagaaggtttcattaagaacgggtataggcatgtaactttgtttgaaagaacaaggtttaaggctcaaaagggttgaactagggatctttgtattggtaggtcatgaaattggttgagatagcactttcggatcaaggatagcctacaatcacttctcaattcaagtttcgcctatgatttcgcctcaacaaacattcagggcaagttctagaccatcggctcggcacttgggctcgcaaatcaaactctctccacactaacactcaaggattgccaaaaatggagtcgagggcccacaacgaccttagatatgatataaacgcacaatggcctcacacgaccatatgacggttgcttggtcaacacaagagtctcaaggccatgacattcaccatccttaacacaacttgatgtctttgatcataagatcgaaggcaaatgtgctaggcccaagtgaagtgtcgcctgaggtactctcactaaaagaacttgaaaaatcaaaaagaagaagaaaaacaaaagaactgactcaacccttaagaaagttgtcacgctatctatcattgggaagagtcacccggttcacacaacattctacccctggaaagaaccgtggcattaagaaaaccaagggcttattttacgaaaccaaatcaaaagaagaagctacaagcctactttgacactaaaacgaaaaaattttgcgaaaataatgaaaatgccgagaaagctcaatcaagagccaaatgaatatatacataagggatgtagaatatacaactaagggaagttcagaatgtaaaattatatacaaatatctatttatcaaaatgtaaagagtaattgattaaaatatatatacaatcatccaatatccaaaaagtagggccacactcccacgaataaaagctagcattgtccccaatgctaactatcaaataagtatcaaaaataacaagggggaagggaaaagaaatggcccctcaaacctggtcagctggtggctgctgctgctgcccactggcagatgtaccctctgtaccggctgggatctcagatcgaccctcagcctgctgctgtggtgctaggacatctactgtttgctctgtctgaggctcaatatctccagtgatgggctcagatggtccctctggtgcagctgccacctctacaactaagctctctgtgttggggagcttcctcttcttcctcggcctgtcctgctcctctggctgcacctgtgctggctccgcggatggctcggctaaaaataagtcaactggtagctgatccgctaccaacctgtcaacctgtgtcttcagcttcaccacagaatccttggaggcctttgtctttctgagcttccggtgctcctttgccaatgctgtgagcgctttgctgtgctccccaactaccttggccaaattggcctgctcttctaacatcttctcctggttggccaggagtttcttcaatgtctcatctatggaggcaggcatctccacagtcactggggctcgctctgcctgaactgcagtggtaagtgtggacaacttggatgttgcagctgacatccagttgttaacactagctaaagtctgagcaagctgactggcggtgaacttgtaagtctttgacaccggaaccaccgggtcaactgtaaaagaaggaggagctgctgatgagcccgcaggcgctgtctctgtaggaggctgctcaatggcagctggctcttcagactggccagctcctgtggaagaggagggttgaccctttttggagcccttgggattgtctggcccctgctgatcataccacgaatacggcctcataggaggcacagaaatgtcatagctcttcttcctaacccccatctccagtaaatacaatgacagggtgtttgggaaggggtagtttgttttggtctcatgacctacccgggagataaccctggacataatattacccacattcagtgggaaccctgccataatcgatgccaccagcactgctcgctcaagtggcactgtgttgtcatgggtggttgggtcaagccggttgcacacaaaagtcaaccacccttttgcttcgaagctcagggtgtttctgtaaatctttgccttagcaggcaaccaagcaggcacagtatctggaggacataatattgatgccaaccacgggcgagcttcttctttcaaagccaacttctccaaatactgtgtctcatcctcatccccgaattccaagaagtcattgagagtcgtgccatcaaatggtagtgtccttttcctcactttagttgtctaggtatcccgaaccacatggcgaacattggcataaaattccttcaccatgtgttagttggcatcctctaatttctccttaaagtacccccaacccacacgtgtacggaattgggcttgcacacgagggttgtgaggaagcagatccccatccaaaaatctcctctccggtatcaactttctcaccggccaccactgtcggaatctatgataggccacctcacttatgaatcttccaacccatgcatcctggctctttgttatatcaattcccccagttgtcgggacaccaccatcactggcactctcatcttcccccgatagttatgctgtgggggaagtggagtactcaccttctcctgcctcatttccctctccggactaattttcatcatcgggctcatttccctctccggactcatcagacgagtccgagactattctgttcaccggtcgcttgaaagtactcacattctcctgctcatgctctggggatggggacacagctaccggaaccatcattgatcctcgggaggctattgaatcagaggacacctcccgggatgggaaatactcactgcctgatgtgtgagaggcagctctgtctgctgcctttattgttttccgggtttgcttcatcatttcaatctcctttggagtccgcttcactactcttcgtaccatctttactttgtaatccacacccttcaccggttgtttatcctttccacctcgttggggttgcttacctccgcgtttttgaaccattgtctgcaagaacgattaactagtatggttagttgaagcccagtagatagcatagcagatcaatacaagcttaacaaaaatacacaggtttcataataaggccaggcggaccgcgcaaaagtgccatgcggtccgcactggcaaaacatgtgcactggagaattgatgcggtccgcacaactcggacatgtggccgcacaaaactcacgcggaccgcccagaattggacgcggcccgcacaactaaagacccaaaattaccaggtctctgaacctcactcacgcggttcgcctgcttatgacatgcggccgcaacaaaaactcacgcggaccgctcaatgttgtacgcggtccgcctacctcagaacactaaacaagcaacgcggaccgcacaaaactcaaaataatggggcagggggtttaggcatcagagattacacaaagacatgggaggaggcctaaattgttcctactcattcatcattcagtggctatcaagaaaggtaaactaacattactctatgaaaagcaagaactcaaatcaagaagttatcgctaaaattgcaaagaaaaactaaacaaaactatgaactaaaaagaaattagaaattaagcaatgaatgtaggagtgttaccaggaatctacacgagaagagagggaatcagttcttcaatattgatgtaagagggctcggagcgaatttttgctaaaagtgtaaaaagtgggcctgggtgagtatttaaagaaacccgtggggccccttcttacctgacctacgcagccgcacaaaagtgacatgcggtccgcgtaggttttgtttcacgcgggtcgcctgtttgtggcacgcggccgcatggactgacttcaaacactgtaacaaatcgagcccttccatgcggaccgcctgacttggtacgcggccgcattggccttgcatcagagatgacccttttttcaatatgacccatgcggaccgcacagaagtgatgtgcggccgcatgagcactgaacagtgcctctgccaatttttgcatctcttttcttgcactggtttaatcttgtctctgtaacactacacaaaccattagctcaaaaatcctattctacaaaagaaaaatttgcacaaatgaaaagacatgggttgcctcccaagaagcgcttgatttaacgtcgcggcacgactcaagttaccatcacaattacttcaagtgaaggagcgccaccacgtggctatcatcaatctggcccaagtagtgcttggccctatgcccatttacccggaacacttcaccattcttgtttttaaggtcaaccgcaccaaaaggtgtaacaccaaccacttcaaaaggaccgctccacttggatttcaactttcccggaaacaatcttaaccgagaattgaagagaagcaccatgtcaccgaccttaaactctttccctcgggcatacttgtcatggagatatttcattctatccttgtacaaagatgaactagaataggcatgaaaccagaactcatcaagctcattcaattgttcgaccctcagattcaccgcaacatcccactctagattcaactttttcaaagcccacatcgctttatgctccaactctaccgggagatgacacgctttaccaaaaaacaaacgatatggcgacatgccaatcggagttttgaaagccatccgataagcccacaaagcatcatccaatttcttcgaccagtcggtcctgttagcattaaccgtcttggatagaatactctttatttcccgatttgagacttcaacttggccactagcctgaggatggtaaggagttgtcactttgtggttgaccccatatttggcaagcaaagagtcgaaagcccgattgcaaaagtgagagccaccgtcactaattatggcacggggtgtaccgaatctagtgaaaatgctcttcttcaagaacgccaccacactacgagcttcattattaggcaaggcaatggcctcaacccatttcgatacatagtcaaccgccaccaaaatataggtattgccacatgaactcacaaacggtcccataaagtctattccccaaacatcaaaaatgtcgacctcaagaatcgtgttaaggggcatctcatctttctttgaaattcctcccgcacgttgacactcatcatatcttttcacaaagtctccggcatctttgaacaatgagggccaatagaacccacaactcaacaccttggacgtcgtccttgccccgccatgatggccaccatagggcgaagaatggcatgcttccacaatacttagttgctcttcctcgggtacacatcggcgaattacaccatcggtgcaaattttgaaaagataaggctcgtcccaatagaagtccaaagcatcccgcttgagcttcttcctttggttagaagagagctcacacgggaccacaccggtaaccaagtagtttgcaatatccgcgaaccatggcatgtcaagcatagacattgaaagaagttgctcatccggaaaggagtcatttatttcaagaccatccgaaggcctcccctcctcctcaagacgagacaagtggtccgccacttgattttcggtaccctttctatccactttctccaagtcaaactcttgcaaaagaagcacccttctcatcaaccgtgctttggaatcctttttggtcatcaagtaccttagggcggcgtgatcggtatgaataatcaccttggcccccatgaggtacgggcgaaacttctccatagcaaaaacaatggcaagcaattccttctcggtgaccgtgtaatttctttgtgcttcattcatcgtcttgctagcatagtacaccggatggaacaacttgttgattttctggcccaagaccgcccccaccgctacatcactagcatcgcacatgagctcaaagggcaagctccaatttggtgcggtaatgatgggggtagtcgtcaacttgtgtttcaaaagctcaaatgcttccatgcacttctcatcaaaaacatacttcgcatccttttccaataacttacacaacgggttcactaccttagaaaagtctttgatgaatcttcggtagaaacccgcgtgtccaagaaaactcctcacccccttgacagagttagggggaggaagcctcgagatcacctcaatcttagccttatcaacctcaattccgttctttgaaatcttgtgacccaaaacaatcccttcttccaccataaagtggcatttttcccaattgagcaccaaattagtatcttcacatcgggccaacacacgatcaaggttttgcaaacattcaccaaaagaatccccgaccacactaaaatcatccatgaagacttccaatatgtcctccaccatgtcggtgaagattgccatcatacatcgttggaatgtcgctggagcattacatagcccaaatggcatccgcgagaatgcgaacgtaccataaggacatgtgaaagttgtcttttcctggtcttctggggcaatgagaatctgattatagcccgaatatccacctagaaagtaatagaatgcccgacctgcaagacggtcaagcatttgatccaagaatggcaatgggaaatgatccttcctcgtaaccttgttcaatttccggtaatccatgcaaactctccaacccgtcacattacgagtcggaatcaactcattattatcattggtcaccactgtcattccacctttctttggaacacattggaccggagaggtccatgaactgtcagagattggatataccacacccgcatcaagccacttgatgacctctttcttgaccacctcttgcatggcctcatttagtcgcctttgatgctctagagaaggcctagcatcctcctccaatatgatcttatgcatgcaaaacgcggggctaataccctgaatattcgctgaggtccatccgattgcccgcttgcgcttttgtaagaccgccaaagtggcgtcaacctgcacgttagttaagcaagcagaaagaataacaggcaaagtgaaattaggaccaagaaactcatacctgaggtgaggaggaagtggtttcaactccaacaccggtggctcctcaatagatggtttggtgggtggagttttccggttctcaagatcaagcgatagcttccttggctcataagaatacgagcccataccatgaagtgcattgacacactccaccctttctggaatatcatcaacatccatattcaagatcactgcttcaagtgggtcttcaacattcgccattgagcttgtgtcatccactatcactgccgtgacaatgtcaacaaacgagcacacctcggtgctattttggttggcgcatagacttgcacacatggaaaaccactttctcattaccgacgcggaaagtcaattctcccgcttccacctccaccaaggccttcccgatagcaaggaaaggccttccaagaataataggcacctcgaaatccacctcacaatctagtatcacaaaatcggccggcaaaataaacttgtcgaccctgactagaacatcatcaataatccccaaaggtctctttatagaacgatccgccatttggagcctcatggaagtcgggcaaggttgcccgattccaagagttttgaacacagaatacggcatgagattgatactagcaccaagatcacatagtgcttttgaaaaattggcactcccaatggtacatggtattgtgaatgcgccgggatcttctaaattcggtgccatggaatggacaatggaactcacttggtgtgtcattttgatggtctcacactccatagaccgcttctttgtaaccaagtccttcatgaactttgcataaccgggcatttgttccaatgcctccaccaaaggcacattgatggtcaaactcttcaacatctcaatggacttcttgaattggttatcccctttttgcttggccaatctttgaggatctggcggaggaggcctaggcaaaggtgcttttgcttttggcaccaccggttccggtatgtcaatgacgtgttccctagacgggttcacggcctcttgggtctcctcctcgccttcatcgatatcaattctcacttcatttctcacccttggttcaacaacttcctcgaccactaatggagcatcatcttcttgaacttcctcctcatcgaccctcgcttgattgtcttgtacaccaccacctctaccactacgcgtagtcaccgccataacatggttgttgtgcccacccttaggatttaccaccatatcacttggtagtgcacccttcgggcgagtgttgaaggattgtgatatttgaccaagttgcacttctaagttgcggatcgaagtattatgggaggcaagttgggcatccgagtcttggtttttcttcatcatttgctcaaacatattctcaattctacccaagtcttgacccgacgagctttgcccttgagattggaacggtggtggattgtttggttgttgaaacattgggggcctttgaaagccttgcccccgattgccttgatttcctccttgaccattattccatccaccattgttgttgttgttccaattgttgttgtttccgccccaattaccttgattaccccaattgttgttttggttgttgttccagtttccaccttggttttgattgttattccaattgccgccttgttgatttccccaattgccttggggcctccattgttgatttccttggccacctctatttccttgaaagttattcacatattggacctcctcgctttggtcctcatacccatcattagaataacctccacttccatcatcataattgtcaaaatttttcggaggttgttgttgttgttgccccctttgccttctttttatcaaattcaccccctccatagcattcacttgccgcggattttgcacttgttgaagctgtgctttggccaactagttcattgtggttgtgagttcggctatggcttgcccatgatcatgtagctccttgtgcaagtgtataacattttgatcaccctgaggaacattagcacgtctttgccacgccgatgaagtatcggccatttcgtctaaaacatcgcacgcctcatcataaggaagtttcatgaagttgccacccgctaactgattcactgtgcactgattggttgtattgatacccctgtagaaggtctgttggatcatcacatcattcatatcgttgttcggacattctttgaccatcgtccgaaacctctcccatatctcataaaggggctccgtcggctctttcttaaaagcgaggatctcatctctaagtaccgccatatgactaggcgaaaagaactttgcaatgaatttatcggccagctcatcccaagtagtgatggaatgatttggcaatctctccaaccaatctaaagctttcccccgaagtgagaagggaaaaagccttagcctcaatgcatcttcagaaacgtttgtctgcttactcccccaacaggtatccacaaatcctttcaaatgcttgtaagcattttggtccgaagccccggtgaaataccctcgttgttcaagcagagtgagcatgacattggtgatttggaagttccccgcccggattcggggaggaactattgcactagcataaccctgattgggcaatatccgtggtgcaccacctctcggaggtggtggtggggggtctggaatgttgttgtcattagcattcgcctgagcatttgcatttctaccccgcctttgtggttggggcaaattctcctcttgctcaacttcttcaacctcatcccccaccacatttccgagaggatcttgtccgtttaaagccattggtacctagatgaaattgacaaacaaaataagtaacaagaaggaaagagaagcaaaacacacaactatccaacaaatagtcaaacaccgtaaagctccccggcaacggtgcaaaaaagtgatcgtcgcaaactcaatccgtagaatgagcgggctaggattactaatacccaatagcagtatcggggtcgaagttccgcagggagcttcaaattggagttgagtaaattgtatggcttagaagtatgttaatgcttctaattggacttcaaacatttttggttttgatttaagttctactttctaatatgatcactactatgcaaaactacaattatgctaaattatactaatattagggttttgtaacaagatagaaaggcactagggtcgtgaaacttacctaggcggataattaacgggtatgaaattctaactcaaggatgtcaagtatggggaatatggataaccgttgcactatagcactcgttctcacacctctcggtagagagaacgattttgcccaattgactctctcgagaccaattgggtaggccaatttgcctaagcaactcaaagttcaagtaaggtaattactctctcaagatttaacctaatactcgggactaccattatcatgggtccatcccaaatccttgttgggttgagggtgaggccatagattctctttctcaagaagaatcaatacccactaagcttgacttagtgtttgcaaccaccaaatctgagtaaaagcatacgcacaacccaaatccaaacacccaactaacatccacaaattaagcctaaacacccattaattacccacactagggttgagtcacaaccctagctaatgggtttagctagacatgatagaactagaaactaaagaaatagtagaagaagaagacataatcattaattaaaagagaaaactaattgattccacgttaaatccacataaaatttcccaaaagatgctaagaatatgtctcacgagctcagctgctcttatagagtatccaaacttaacctaaaaaagtaaaatgttctatttatactacacagtaatttccgaacaaaaatgcccctgagggtcagatgcggaccgcacagaagtgacgtgcggccgcctagggtgttttggtcttcacttcatttgttcaggatcaagagatgcggaccgcctaagagtggagcgtggccgcgtaggtcttttcaggcggaccgcacaaaaatgatgtgcgggcgctcatgaagaaatgctggaatggttggtctttgatcttgctcccacgcggaccgcctgcctttgatgtgcggccgcgtgggttatgtgtctgaaagtctgttctctgaacttttgaacaggcggaccgcgcagatatggatgcggcccgcgtgagtcttccttcaaattgtcatctctctgatccttttctggcggccgcatgccaaaggcaggcggaccgcaatggtcttgtaaaaatgtccaacactctgaatcctcctatgcggccgcgtgcacactcaggcggactgcacagggccttttagcctccacttttgttaactccttgtcgcttggcaggtttcactccatttttgagcaaatttgtgatctaagtcattttgtcgctcaaacctgcaatcaagcacatctgtaagtgttttgggactaataagaggtcaattaagcgcaaagctaaggcaagaaaggggcataattcatgtacaattcacagttatcacctgaccttgggttgcacatgtggcgaaacaaggtgagaacattgttatgcatgcatggcgagacaaggttctcaccacgtgtgcactaataataaagtaagtgcccaaccttttctcgccacacatgctccctatcacgccgtatgtgtaaatatcaaaagtaataatagcacggcagaaacattgggcaacccaataacacccgcacggtagaaacctcgtgcatcacaataacaagtacaacaataacaacgacaataaatacaagagtacatcaagtaaattaactcaagaactttcgttcacaaagaaactgtagaactatctcacaaggaataaccacaaaagagaatactaggcttaataagaacaactcaacaagggagaaaataatatttaacaacgatcccacaatacacacttcaacaacaagggagctaacacgagtcaaataattccaaataagggcatgtcaactaagatgtaagatatctaaacttcttttaatgtagggcgattacgaaaaagatacaataatttcaattaaagataagtagcggaaagataatcataacctcaatcaagactaaacacttactggatgagatatgaataattttaaataaagataagcagttgtagaaagatagcataacaatagaagagataaaaatcttcagttaagtcaaataagagtcaattaggcaataagaataaattaaaaagcaattaattccaattaaagaatgtagaggtgaaactagaaaataggaaactcaatcatatcaagaccaacttcatactcagcgaatataaggacctaaggaacctaaaaggccatttttccacagataagatcgagcacgcactcgtgacctcgcgtacacggactacaataagcatagaagactcaaatcctaaagaaaaaaacctcacacaaggttaggcatgatacttacctcaaagaagacagaccgatactttagaatgaacatctagagtgaaatgaccttcggacggctcaaatctagccaaaataacttcaaaacataaataaaactcataagaaactattttggatcataaatcctcaatctttattaaaaactaaaaatcaacccaaaagttgaaccctaggttcgcacctcggaatccgagaaattttacaaaatccgaacacccattctaatacgagttcaaccatacaaaaattatcaaattctgataccatttcgcccctcaaattataattttacattttgaaagttttattcaaaaaacttccatttttttcaactcaaaacacaaattaaatgataaaaataaagataaaatcatggaatatgataaattcaaggtgaaaaacacttaccatgtcatttttcttgaaaaacccacaaagaatcgctcaaaacctagctttagaactccaaaatggtgaaaatggctaaccctctaaatagagtacttttatattctgcccagatatttgtacaccgcgatcgtagaaaaggagatgcgatcgtgaagagtaaatggccactgcccgggattagtggtacgcaatcgcgaacaaacttatgcaatcgcgaagaaggaaaatctggttgcctatgaactgagctatgcgaatgcgtgaagacgcatgcgaacgcgaaagagggaaaggcatacatatgtgttcacggatagaagaatactaacgcatagtggtattgatcactagtgcccagggcctggatttgcactacgcgaatgcaagatggagaacacgaacgcgaagataaaatattccctcctccaaaattactcttcacgaacgtggaggagcagacgcgaacgcgaaggagaaaatcagatgacagattcagcagttcaaaaatagaagaaaatagcccctagcctatccgaaactcacccgagactcccaagaccccgtctaaacacaccaacaagttccataacctaacacggactcgctcgaggtctaaaatcacatcaacaatcctgaaactacaaatcacacaatgaatcgaacttatgaactttcaaatcttccaacttctaaaacccgtgccgaaacctatcaaataaacccgcaatgacgccaaattttgatacaagtcccaaatgacataacggggttgttacagctcttggaattacattttgaccccgatatcaccaaagtcaactcttggtcaaacttctccatcttccaaactttaacttttccaatttttgccgaaatgcttcaatttaccctaacgacctccaaatccaaattcgagcacacacctaagtctcaaataaccatacgaatatattgaaatcatccataacccatgctagagtcatttacacaaaagttaaattccggtcaactcttaccgcttaagcttccaaaacatgaatccttcttccatttttatctctgaataattcgataactgaactcggccacacacgcaagtcataatacataatatgaagctgttcaagaccttatgccggcaaacgaaacttgaattctcaaaacgaccggccggattgttacaaacggtcatggcggggtgatgactgttgctcaatgggatgtttttcatggttcggcaaaattttaggtggtttgcgtccggccgcccggatccatgctgatggcatgagagcacacgaaaatctaaaatttgggcagaattctagttttatggtcctaaaacgcttaaaaacgaggaacggtcatggagaagcgatgactgttgttcctaggtcattttttatggtccggaaaaattttaggtggttcgggtccgatcattgggatgcatgcaaatggattaggttatagcacacgaaaatctaggaatcaggagaaattatagtttaatggctctaaaataccaaaaaacgaggaacaagtcgctttttatggtccggcaaaattttaccctgttcggatccgatcgcctagatacatgcagatggcgtgggctgtcagtacacaaaaatttgggaatcaaacggaatttcagttttatgctcctaaaacaccaaaaaggggggaacggtcatggggggtgatgaccgttgttatttaggttatttttatggacccgtaaaattttaggtggttcgggtctgattggtcggatgcatgcagatagcggggtatagcacaagaaaatatgaaaatcgggaaaaaatccagttttatagacctaaaacgccaaagctacggggttcctccgaactcttcattaatactcttcctccgcccctgtttttttatgagacttcaaatttaatcgggttccaatacagataaaaaaaatattttgaaggtgctttatgaagttgagctaataaacaatctatatatccagctagcaacttaataacatgtctggtattccattaatgtaatatttaatcttagcccacaaaatgttcaaatgatggtgctataaacagacgcaacatgttcattaactccgtcatatcacaaactaaagtagtagttatatagttttcaagcaagaaaagaaatgggactaaaagcatttatgcttctaatccttgctttggctactttacttgtgataacatccaaggttgcagctaggcagttgaataatttctgtgttccaaggccttaaaatctctttctgtctcatctcaatttgcgtgtgtaattcgggcacgtggctggaaagtcattatgtgaaaatttgtgaaaataaaaaaaaagtgccttttaatgaatttaagtttatttcgatcaatattttggcaaaacggacacagacacataatttgacgattccggaaggtccaaaggaaaatatgggacttgggtgtatgcccgaaatcgaatttcgagttcccaagcctgagaaataatttttaatgaaaattattttctggaatatatatgagtttttggaaatgaaaaatgtttggaagttgatggtatcaggcccatactttttcaggatcctgttataggtcttatatatgttttaagttgagcctgtaaaattttgtaagaaacgaaggtcaaatgacgtgaatcggaccctcggttgtgaaatttggaacttaagtgttcttgaggtttttctttgatttagatgttaatttcgtggttaaaggtgttagtttggcaatttgatcgcatgaataagttcatatgatatttttgagttggtatgcatgtttggtttggagccccgatggctcgggtgagcttcgggtatgtttcggggtgtttagacttacgaaaaatactgttgttgcatcaattctggtgtaactgcacctacgagtcaagcaccgcatgtacgagctcgcaggtgcgcatatagggcagcaggtgcggtccatccctatcgcagatacggactagcttccgtaggagcggatcccctactgcaggtgcggccctagcgggcctagtcatttccgcagaagcggtcaattttccacacatgcgcttgcgcaggtgacacccaaacaccacaggtgtgagagtcgggcagtgaagtcttttaaaataaactttagcgttttctctttcaaattttcaccaaaaatagaaggcctagggcgattttctctaaagattttctttccaaatcataagtaagtgtccactacctgatttctttcaactctctaatgtattacatcaacttttataaaaaattctagggttttaatggtagaaaattgggaatttgggtagagttaggactttttgaataattgaaatttagacctcgttttggggtcggatttcgaaactaattatatatgcggactcgtgggtgaatgggtaatcgagttttggtccaaaccattttgaccaaacgggtcggaattgatttttgaatttcttgaaaaaatggtcgaaaacctataatttagcattaggtatgaattctttagcatttattaatgttgttcaattaatttggactagatacaagtaatttggaggcaaattctataggaaaaacggtgtttaaggcttgagttggccgtgaaaatttgaggtaagtgtttggtctaaccttagcttgagggattaggagtcgagtcttatttgctatgtgttatgtgttgggtacgacgtataggcatgatgacgagtatctatatgtcattgtcaagcatgttcgtgagtcttaaactgaaatcgttgtgatcttaataagcactacaaatgcctaagtcgttgattctctgtgtttggaaagaattatgattattctcgtggaaatttcttatggtcgagtattggttctagttgaggtttcttttgtgaagttaaatgttgcaataagtttggttatagctgactcccttgtcgggacgtatttacttcttacagtcgatttccttgccgagatattgttgttatcttattgttccattgtcgagaatcttttgtgattgatgttgaattgtatatttggattgggttgcacgccgcaacaatattatatttggatcgggttgcacgccacaacagtgatatatgatatggattgggttgcacatcgcaatagtattttatgatttgaaacgggttgcgaaccgcaacagtaaaggataaaagttgatattgatgcgttactgtttccttattctttctgttgtgaattttaaattattctttatgcttttctcctgaattactattgataaatgatattcccccacagcatgtccccttcccatctttaactgcaagtttccttattattacttgatatatatatatataggccttaagtacacatgtttagttggtagtcttgtcccagcctcgtcactacttcggcgaggttaggctcgacacttaccaacacatgggttcggttgtgctgatactacactctgcaccgtgtgtatatcccggaacaacagtttttggaccttagcttgggtgactgcctttagtccacacggagatccaaggtagtcctgcaggtgtccggaggccctagcatctccctctatcttttcttcctgtttcacttatgtaattcagaaacaatgtcgcatttatttttcggactttgtttgtagaattcttagacctctatagagttgtgacactagtcttgggtagtttttgattaagaaatcatgttggaattatttaaatggtttgggtagtctatgggcaaaggtgagattccttcctttaaagacctgttcacttcctacaagtaaaatatatagtttactccctcagtcccatatgtaaacagactttgattagtacaaagtttaagagataaagaaagatttttgaaatttgtagtgtttataaaggtaaagtcatacgtattcgaacattatccttggtatcaataacttgagtacatatataacttagggtcattggtgtattatcgtattccttgacttctattatgacatgttattgctttcatttctgctttttgaatgcaatacctagtgttagttttgtattttcattttagttttttgatttgtgtccttgttgcccttccttttaccttttctaagttgagggtttatcggaaacaatctttctaccttcttgaaaataggagtaaggtctgcgtatacactttaataataaaatatatttatacaaatatttgcgcacacactttattgtgcgttcttaataaaacgcataaaatagacgaacttatctttggttatttaacagatcagaagagtatatatgcaccacaatttctagatatttaggataaggtagtcctacaagttgagcaaacttaaaaattctttattgcatgattatccagtaatatatcaatatttaattttaatgtactatgatattatctccccataagttctgtctgtcatggtggaatgactgattagtatttttttattcttaattaatagttcgagtttgaattatgaatatagaatagcttttattatagcatatatattgcatgattatcacgttttattttaatttatttgaatttagtattctttcatatagttgccatacatctttgtttttattatttttggtttgtaggtcgatatacgtaaaccatttggtcatattgatgtgttctacggacaaggtttaataaatggttaatcattagtatgaataatggacccggagtaataatgaaaatagcctgaattggttagttttcggactagtactggtaataaaaaaaagccaatgtttgtaaaattattgataaaataattattattttatgcagcgataaaatctggacgatactctagcagaaacacggaaagatccagcataatactttagaatatggagctcctgcgtattaacgtccaatatattatattggaactcaagcacattatgaaattccaacatattatgctggaatctcacaagtaaaaaattcggcctccaacatattatatgctagaactttttggattttttgagtgtttttgttcaattttatctttatatgaaaaaaagactagatttcgattattttcgatattatggctatttttcagttaccggatataaaccaagctatttcttttttttttttttatcgcagaaatatgggagagaagtgttttgcagtttgattttatacgacttagggtatttctaactaatacgtaccttatttttcactcggtatttatatctttagagctgaagtgtttgtttttgtaactggcgaacttgagctctagagcttaacttcaagccatatcgatgatattcagttcgactgaaatattcttagcaaccaagtctaaaacaaaaataaccatgacataacacacatatattttaaaagaacagatgaaactagtgcttggtaaaagaagttcctatttgcactatctgtttcaagcacaagcagttatagcataaaaacaaagggagaagaaagatctccttttaatacaaaaccagtaaaatttataggaaaaaaggaaacttgcttgattaaagtatcgaaatatgcagctgctgctgatcagaaaaaacaccatgaaatcatgttatcttgaaagaatatttcagtcgaaatcaatatcatggatagggtccatttctcgggatgtgtcatttaaaaagaagaagaagaaaaggaaagaggggaacggggctgaagttatttaaaaagtaggtataagttaaaagttttaaaaaaatgggtataggttaaatgagggcgaccaaatagggcgtcccgtgcaattttgacatatttgtgtggttataaaagctgttcattaagggtgaagtgagtaaaataaaaagtttaaacgtaaactattttcaaataaaaaaatatatcattctttttaagcgaactaataagaaatatatgttatttaaattgaaacggaaggagtatgtcatattagtcgttcaagggatcgcaacttaggctagaacattataactaacgttcggacatagacttggttaatacttgaaaaaagagtttttgaagttgtgttaaaaattactttttgaaagttgaaattgtatttgaacatgcattttatttgaaaaaagaagttacagttttgtaagtggaagaaaattttacctaaaaactgtcctagaccaatttttgaaaaattgaaaacaaatgaccatatttcatgaacaaacaatatttttaattttttttgaaaaaataacaaaaatttatgatcaaacgggagcttgattgaagtataaaagaacaaacgaactccgaaattccatatctgtcggcacatctaactccaataattaacagcaacaaggcccaaggaattgactcttaataagcaagtagattaggagtccattgctcaaatggtcactcaattataaatatttataattttgagggtaaaatagttatttgacaatccaaaatattgaaaaatctcgttgagtgaccttctgagtgcaataggtatagttgaataattttgttattacaaaacgaaagaaaagtgactttaggagattatttggaaaagttgagtgaccatttgagtaactgatacagtagatcggattcttaatttcttttggaattagactgtgattttttttatttgacattttattcgtaaaaatggcgtgcggtagccattttactttttatccattttactaatctgttaaaattaacatgaaaagatagttttaccctttcttctatctcttttccttcccggcaactgcgttttttgttttcagaatcattattgctcaattctacttcatttggctagttcgttcgaatacaattagattgaccaaaaagtgctcatatcgatttatttcatcatctttcattccactataagattcatttttcaggatgagaaaataaataaatgaaagaaactgtgtccttggttatcggaatagttaaggacaagtagtcattaacttagatttacaagctcataaattaagaacaataggtcatgatgtcctgaacttagactaacaaactcaaaggtaaaggacaataggtcctgaacttaagctaagaacccaagagttaaggataataggtcccgaacttagactaacaagctcagaagttaaggacacttggtcctgaacttacatttacaagttcaaaagttaaggacatgtagtgctgaagtcttgaagttaagttcaaaagttaaggatatgtatgaagtcctaaacttaaagttacaagttcaaaagttaaggacatgtagtcctgaagttaagttcaaaagttaaagacatgagcagaagggtattttcgtctgggcagttaaagtttattaaggcagtgactacagactaaagacattttaaacagtggcttaaaagtaagtacatatgttattagtggctaaccgtgcacttcccctattttattcttgacctcgattacttgcttttcacaacaacaacaacaaaaatggtatttaaattttatgctttgagaataagcctgagttcaagtcttcaaaagaggcggggtcagaatttaattaaatttacgagtttgagattctaccccgtttaggttatgggcaggcgactcaacaatacttacagcataaagctagattttaattggaggcccttcaataataattttaacagatatttttatttaggatgtatttttttaattttttgagatgcaaaattattaattagttttctgtaatcgatttcttctaataagttagtgacttgttcatctaaaaaccactcccctgtagtttctaattttgttttttctattgtttgcgtaaaatttataaagatcacctttttaagattgtatatttcaactcttctccttttttcttttttttggaataacaacatttatattttctagttctcatattcaaattataataaatatctaaaaaataaacctatagggtaaaaataagaaatataacaaatttaagataaaaagatattaaaaaatcagaatgaaagaactagattcaagaagtttgaagacttcaaatatttttcgcaagctttaaacgtgagaattgagaaagaagagaaaatgagacgcaacttgtagaccaggtttcttcgtatatctttggtccacacaataattcacattttcttcaattatttatgcattcaaatcttattataaatagaatccaagattacatcagtttcttcatcccttaatttcaaactaagctttgaaccaaaaaaaataaaaaaaatatgggttctaaggcatttctgtttcttggtctttgtttggttatttttttcctgataagctctgaggttgtagatgctgagttggttgagacttccaactgtaagcttacttgataatctcttctctcattatttggtataggatttatgttatggtccatggcaaggaatgggacttgagtcccacatcggtactataaagtgttgatgtggggtttatatagccttgggctttcccatcttaataggtagcttttgaggtgtggttctccctaggttgtatcaatggtatcagagccatccaccgccctccgtgtgcaccgtgccatggatggtgacgccggtatggcagtcttcgcctggggctagaaaagtctagcatacagccgtcgggaacgacatatgcggagcgtggtggtttgttatgatccattgtaaggaatgggacttgagtcccacatcggtactacaaagtgttgatgtggggtttatataaccttgggttctcccgccttaatagctagcttttggggtatggttctccctaggctgtatcaatttaaataattatatatgctgaaaattttaaaaatttatacgctattagtatattttaacatgttgtaacattgaatattctttaacctttcaaattagtgtttatcagctagtaaagcttaatttgattttcacatagagctagtagttgagttacacttttgcatttactaattaaccactataggaaaaccaaaaaaaaaaaaaaaaactcttactatatactctctctattttattttatatatcttaatttgattggatactaagtttaattaagaatataagtaaaacttctaaatcttgagatcataaactaaagttttataaaaaatatacttagaatatcttttgaatcttgtagtattaaacatgtcttgtataagtagagtcataaagggtaaaaatgagaaaggtagaacttaaaacttatttatttagtaaatatataaagaggtatttgaaaatgtttggacatgaatacaatttggagctattttttaatttttgtgagtgtttgatgtgaaaattttaaaatacaacttttggagtctttcaaattctgaaaaatttcgaaattcaattcaaataaaaactgaaatttcatgatcaaacactgatttcggaaaaaaatgaaatttgtttatggccaaatgaaccatgtttttattttcacaattgatgcagcaatgaaattggataagaagaatgaagtacacgttgacggacatgatggatacaatggcgttggtggtgatggacatcatggtggccgccgtgttgttcgtcgtcgtcgtcgtcgtgtaattattaggaggagatgccgctatggttgctgcaagaaaggttacaatggttgcaaaaggtgttgttcctacgtaggtgaagccatggatagaatcactgaagcccagcctcacaactgatcattatgtgcatataaaaagagtttaaactatatatatcgtgagtgtatataaattatatgttgtgacaagatgtaataatcttgctactttagaccttgctcgtaacaagtatgaataatgccattcggttcttatggatggtgggtcatgtaatgttttgttgtacaatatattgtgataatatgtttctatattgtttattttctttttattttagagtaaaggtttttcttctattttatgaatcctacaattctcttttaatccattcccgtaaattcacaatccaagcatgcagagatggaactagaatatagcttacaggtcatagtcgaacccaataattttattaaatatatacaaactctaagataaacaaaataacttagagggactaaaatctcgacgatgcattcatattatttgcagcttcttcgagaaaatctatcaaattgagcaacaaaagttttcacacaattcgtttagtgtctattcctgaaacttttctccaagttgtcattgtagtgtaatatatacatttctcccttctggtttgaggctgtttacctcgaaaatggtaactataattatatttaattttgtggttctaaaaatacgtaatttactttaatagtagttgttaaatagtagatactcaatgtaagtaaagaaaataagaaatacaaaccaatagggtcgcaagactggacctcgagctgactggagcagggcctcgaggtctagagggggctaatagcaataaacaattgataaagaatcaatgataatgaggacctcaaaggtggcctttcgcggttaataatgagcaataaatatgtagaacaattgtataagcaaagagcagagaatgtagtattgtattcaatgtgttgtgtaataatctgaatccctttccatgatgatcgtcgattgtactgccccgagatcaaccatagtgggccttcaatgttctccctcgagggacacatctcggtgtcgttcctcacgttctgctttggggttctcgaggttggccgtggagcggcatagtatccccaaaatcgaactccccaattttggtcgtatacagatagtccccgcgtttcctagaatgaaatcataagaaacgatcttgagttattgcctctttgatgcccctgtcataacgtcaaccacgtgagaccattaaatgtcatgacagaaaagttgtacaggggtcttatcaaatatttttctcgaaaatcccacaaaccgctattggtcgccctttcaacagtttcctgccttaacccttctttcgtgttcaattcgagaccccagaggcgcatctgttgcactcttttccttcgaccgatttttatcctggaagaagggtttttacctgctaggtttttaaccaggaaacgtctgcaagccgcttaaggggaaactccgcaaaatatattcaaaggctatcctgacggccgactttttaaggcgaggggaatttcccccgaaaaactgcccgctcgaaggagttttgaaaaatgccaaatgaggtttcttatagggagacgatgtatcgggccaaacggtcgatgtattcacacccccgccaaacggaagcatgtactattgttttgggcaatgaaaaaacaccttttccatgaaaagagagagactccttcttagattaaggcaacatgaaaatcgtcgaagaaaccaaactcaacctaatatagattgactcaacacaataatacatgtattgcaccaatggatgagaatatcttccaacatctcattctccaaaagggaaaatcacagtatactctcgacaaaaccctctctgccaaatatgtcctgatactcggagacttaaacgatttggtgcccccacgaccccagggtcggaaatccgggcttatcaagcccctgcaaagcaactccgagctcatgaggaactgtcttcaagcttaaacaaactcgatgactcggagactgtcattaatctccatacgctggaaaacccgaaactgtacgacccctagtgagaagcctcggcgtaaccagatatattctacatttcacaaactgtaagacctcaacaggcatgacaaactataagacctcaacaagcatgaaaatcccgaagtttaggctataagtcacatttgtaagaatccctaaagggcatactctcggcgcagacaccaaaattatcactcgggatcaaaaatggctacgaccaaatacatatgagtacggtcaaaacggatgatacagttaaaataacgcgccccggagacgcccgactgtcactaaacaaaatcgcaggccactactccgaatatacttcggaaagaatcgattaaaacaggcttccctcaacaggcaaaaaacaaactccgaccatgtaggctccaaaatcgcaaagcgtcgatccactcgacctacgagctatgaacctttcgaggtgctcaaaacttcgctgacaacgacttgaaatcgaggtacttctagaatcgacgatgggttaggaaaaaatattttgaaagaccttaatgagcaaaaaacaaagcctacaaaaattccacgggcaaaaatagcgtaagagccattgtcgccagctaagtaagcctctgggccacatattaaaaggtctctacgaccaaacatcgtaaaagccattgtcgccagctaaacaaattgacaacttgaggattaaaatgagctccaatcgtaactcgattcggacaccggatcaaaaatagttaactatgcaagcctccggtccacatatcaaatggtctcaatgaccaaaacagcgtaagaggcatcgccgggtagaaaatcaagaaaacttaacggtcaattacagtttgaatcacagcgtgactcggagactggaccaaaaaacaactaaactacaatatgcctaagggcacgatataaacaccaccatcaatgagcccccgggccacccacctataaggtcacttcaacccgaagcataaaaggccatcgccgttcgccaatgcaggcacaaagtaacttgaggatcaatcaaagcatgagtcgcaacacgacttggagactgaacccaaaataagttaaagcaccaaacgcccaagggcaagaaataaaaaccattattgaagacccagacaaatgcaaatctcgtgggtaaattaagctcgagtctgaccccgactcggaaactgaacttgaagacagttaaaacatgtgaacctaagggaaaatccgggatcaaatcgacccaattggaactccaacgagcagaacataaaatttgcagggttccccctcttattgctacatattaacgatgaagcgcaaccccggcctacatcgtataatggaggctatatatacacacacatacaacaaagaaggtgggaaatggtcattctgcctttttccggcaattaaactagcggtctcctcctcaacaccctcaacatcggacaataggaacttggcatcgtactccactcctttggcttgttcaatctccctcgagagatcagagcccccgacatgaatctcctcaaaggattttgctccaggatctgcacctcacgtactctttgctgtaattggcatgatcatcttcgcccgagcagaatcattcacacaggcaacctggatttgcgcatcgagagcggaagctcggttcgggctctctctttggcctcagaatggacattcacgtgcgcccgcagctcgatgaattcacattttggctttgccaacctcgccccaaagttgttccatctcatccgccttgctcttcagctgaaacaacaaaaattccaagggcaaaaagtgaagacaatcaccacccgcccacacggccacaaaggataaaaaggcaagcaagctcaaataaaggcctaactcagggaccgagcctaaaccacttgggcaacacataaagccctcaacacctgaacgcggcaaggatcaggcttaaaagccccgggcctgcctgattggttctgaacccacgaagatcctgccaaaacacgggagccatcccaccagatgagaggcaatacaggaagagatacaaaggaggtaaaacttcaagatttctctctcatatatatatatatatatatatatatatatatatatatgctcaaaaggtgtgctctccatctacaagcatgccccataaacaacaaaatgtaaagtggcaaaatctagcccaagcctcgttcttcgtggcatcgcaaatgaacaaaccaggtatcacgcccgactaccattgctcaggaaaaattctaccagaaggacgaaacccctggcatgggtctcttcaaacacctgtcccgaagatctacgacgatcgcgtccctcgaaggcccgttctgacccagctcaatcgtcggcaaaaagtcgccactcctttatcatcctcggtccagcgcaacacttttcttgttcagatagcggttgttcccaatctatacttttgaagaaccaagttgcagcttcacaattatatccacttgggttgaagctcgaagcctgcatttttgatacttcaggtattcttatcccgatcggctccatggataaaaaggcaaaacgcttaccacaaagggactcctgcctcgtcaaaaggtttttgtaaagcgaaatccaggaccacgaagaatagtcccttgacggaacatctcaaagaccaaagatacggggggccatgctgaaacctaccacgacgtaaaaccagcaagtctactcaatgacggagcatcctcctgatgaccaaaacatttttggccaaaggaaccaccgcttcggaactaaggtcttcaaaaagaccaggctcgaataatgcactctcctcagaagcacgtgcccatttcgtcccgataaaagctccttcatgatcaggaagcacgcgtctcatatatcaccatactgggcctttgtcgtgccctgaataagcagctgttgagggcatgactcactggcatcacaaagtcagcaaaatcccaaggaccccgggaatcggaagcaacctcacaatcgcatgcgaaaagggtcgggactagtcaataccgaccaaaggcaccgaccatcagcactgtcttcagtctcaaggtaatactcagccccaaagacctcctccaaagcaagaaggcgccccagcagaccaataatgccttcaccgaatcggcatttagcctcaagttcaaagaaggctcgtttacgaagaaatgggcgtccctaacaaacgcccatgcaaaacagattccggataacgaccaagttggcccgaaacacagcgaggactctattcgaagattgcttcatggatgtcaccagcgtcccgagaccgtgagccctcaggcaggccccttctcaaaagccattataaggtcccaagatgtcttccacattttcacacaggaaaagggtcccggtggaccaagattattgtcctaattcgggtccggttcgagaaataacaaaagaccctgtgcgaggtcactccataaagaccggggaaaatactcaaagccaatgtcgcaggtggcgaaacactatcgtgcaatcaaaattgccgaaaaatatatagaaatacagcaagcgtcaaaagaagaaatcaacaaaataccttttgtatttatacaaatgttcatttacaacgaccctcgatgggtccttacatatggctacatcacacatgattagaaaagcccatagaggttcctaacaataaagtgacgaagcacaaatgatacttatacagtaggggcctaaggatctagcatgttcatgctacgtctccatcgtcatcctctcgagcatataacctcaaagacaatgtcttccaaagttcgacaccctcgaggaccacttcccaatcctcccagaatggcatcttcaaaatggagtcaggggagaagagctaaacgataaaggagaagccggaagaatgcgaagaagtggctggatgaaaaatttagccactatgagctccgccaatacaaccgttttgaagccacttcctgagaagttgcctcgggtcggaaggcaacagctagcagatattgctgacataccccctgcaatccaaaaagggtgtaacacatcgagcggaggacggagggtgagcagcgatgcataatccgagcccccttttgagcagcgatacataatccaaagtgcctccggggtcggagcaaatagtccctctgcctcatcgccccaggccaacaacaacagtatcacagaggcacaactccgcccaataaaaggaagaacagggatttggtccacggaacacatggcgcaaacccttgaggccacagactccaaacatgacaagatggcagaaattcaagattacaagaaaggaagaaacgatgggtatcaaaggaaatttggataagaggtcaaccatgaagatccctatttatagtaatagcaaagtaactgatggcgctattacctccctcagtaaacataatagcaggcgcaattaatgcattcatagaagctaaacagatatcaacaaaaaatttaagaatcacgacacttcgagtaatcctagagaagcgggaaggtaaaacgcttcgacaactgtaaaaaaaagggtttcaccgtcggcatgacgccgttacaggagatcggggaatagtatgtcagtatcatttcttatcacttccctctaataaacgcggagactatctgtacatggtgaaatctggggggccaatttccctttgacttacttcgaagggtgatcccggaagaatgggatctcgagtcagtcgcttccctcaaggtctgtggatgctccaccaaagcaatatcggccggagcccccacaaacacagaaatctcccgatgaatgcatccgggctcgatcaagtctattcgagtggctcgacgacagctcacttatgacctaaagctaaccggctgtcacatcccattcctttttatcacacaaagtattttgtactaagtttgtgcttcctttttctataaaagaggggtcactaacgccttgtaaggcagagcaccaattatcctactcaagtgcaataatattttctctctcttttcctctctaatttgcttttccccattggctcgaagccatttatcttcgattactttcttgtttgttctttgtttattacttggtactggctcgaagccatcttcatatataatacccttttacctgttcttcattctataacttaatattggccgaaaagaaccttctctaattgcgtctttaactattatcccatcaccaactatcctcgatactgacgtcgactctggggtctcatcgactagtcctgcagccgggctaaaggcccctcgatttgattactaccccgtcttagctcgtaattcatcgttaagcttggtattagcatcaacttccttaacaactagctcaggaataaatcacatatttttagaatcccaatcacaaatttaatttttgttaccaatttcatagtaaacacagccgattcacatatatatagttgattgcgctcactaggggtgtgcagatctcctttagaccaagcgctatattgttgtggcgtgtagcccgatcccatataatgtaatcaacatattgttgtggcgtgcagcccgatcccacaaaatataatcaatatattgctatggcgtgcagcccgatcccataaaatgttatcaatataacatgatgcagtgtgcagcctaatcccaaaatatcactctcactcagtgtcacgaaccaaaataaaaccatggtcgtgatggcgcctatcgtgttacaaggcaagcctacttcccaaaatattactactaaaccgattattagaaattaataaaatatttcaacataaattttctataaactaaatcatctctaaatataatatagaaaaatatggaaatgagccccaaacatcggggtgtcactttgaaattatcaatcaaatcccacaaagaaatttaacgaataaatgtagcaacaacaaaagtaaatgcaacttcacaataatttatgtccatcactcagcactcacactcagccctcaacactcaacactcaatacactcaacattttgcgctcactgggggtgtgtacagactccggaggggctctcaaagcccaagcgctaagcactgacaactaacgtgctactataacaatacctggatccgcacggtcaactcatgtgctacgcggacaactcacgcgctatggtatcaatacctggacccgcacggtcaactcacatgctacacgaacaactcacactatatgatattaatatcctcacaaccaggccctcagcctcactcaatcatgtacctcactagcctcaccatcatcaacaaataaggggactcaacccacatcaaatatcataacttattagcaaataatatagactgaggtaaacatgtacaataattcctatgactgagtacaaataatgtgagcatgaataaagcctaagcatgatctctaacatgaaggtagacaagttcaacaataaatagcggcgtaaacacaaatgatcgctatcaggcctcacgagacggaccaagtctccatccctcgaggtatacacccacacgcccatcacctagcatgggtatcaactccaaatagtgacacgatatcaaattctccgagtttataccctcaaagccagagtaaaaactgttacttacctgaaccgcataagattctactccgggatgccctcgtctctggactcggtatccaaaatctctgaatctaactgtaatcaaattaataccatcaccatgtgctaaagaatcgaattccacaataaaaactataaaatatgccaaaaaatccaaaatcggcctaaacccgggccccaagcccacgcctcagaatcagtcaacaatggcagaatcataacctcgtcctctcccgagtctaatcatataaaatttatcaaaatcggactctgtttggtccctcaaatccttacttaaaactctccaaagctcaagccctaaatccctcaatttcattttgaaattatcaatcaaatcccaaaaacgaagatggattcatgaaatgtaaccaaatctaagtaaagaacacttaccccaatccatatggtgaaaatctcctccaaaatcgcccaaatccgagctgacccaactcaaaatatgaccgaatgaacaaaccctagttttatatatttttctgccagctagtctacctcgtttctcatgtcaaacgatcccaaactcgtattttatgccactaatggattccttgtaaaattatagttaagttaggcttttaaatcactcaatttgaccttataatgaatgcggtatttagattttaatatttgtaaatagtgcagatatttaaatacgctgctagtggcaatttcgtaattaatctgaaaaatccgaccaactaattcttagtaaaataaccctaaaatcaccatacgatgtccaaattcgatgattttttttgctacgggtccgcaattacgatacgatctaattcttcaatcaaaaaaagaaatcggagctcatttgttcaatatgatatcatttatgcttgaagaaacaacgtcgaaacataagaaaaacgagcgcaacacaacccaaacctatccaaaactcacgcgacgtcctcgggacctcaaccaataattttaaaaagtcacatataactacccgaacttagtcgaacctccagaacacccaaaacaacaccaaaacaccaaatcaacctcgaattctagcctaaaaatttctaaacttccaactttcgccaattcaagcctaattttaccacggaccttcaaattatactccggacacaatcctacgtctaaaatcacccagcgtagctaatcaaatcataaaaatccaaatccgaattcgtttactcataagccaacttccgattgacttttccaacttagctttctaaccaagagattaggtgtttatttcactccaaaactactctgaacccaaacctaccaactcgatacaactcaacgtagctcaacaaaacataaagaagcatatatgggggaaatggggctataactctcaaaacgacaagccgggtcgttacatcctccccttcttaaacaaacgttcgtcctcaaacgagtctaaaaacatacatgaagtctcaaataggtgaaaccttcagcaataccttctcatcatattcaaatcatataaactcatcttgcggtcatatcatgctcatcacgtatccaaccaaccattattttcactaatagggacactaccaaacatataagtctactaacacgcgttcacataatcaataccttagtgctcaatctactggcaaaacccagtctcaaatcctccagactggcccaacatcaatacacagaaatcacatctcgcaccttattcagggaatcataatccatcgatgcacaactgataccgagtgctcatgtgcgcatacgaataggtggaaggaattcgaagagttatacttcaagctaaatcaatatcgcatgataagaattcaagaaggtgaagttttgctaaagcttctgcggcctctcgaagacaagtacaaacgtctccgtaccgatccgcaagaccctatgaaacccattcatgactcgtgagacctatgtaacctaggccctgataccaactatcacgacccaaaatcaaaccatggtcgtgatggcgcctatcgtgttacaaggcaagcctatttcccaaaatattactactaaaccgattataagaaattaataaactatttcaacatttaaattttccataaacaaaatcaactctaaatataatatagaaaaatatggatacgagccccaaacatcagggtgtcactaattcatgagcgtctaaaattataaactaagatatataaactatctaattgtacaaaagatgaaataacaaaagaagtaacagggccctacggacgctagcagctaccttgcaatctccaaagatagtcggcccgaactcaacgatcgccaagctctaactcacctggatctccacatcaagtgcagggtgtagtaagagtacaaccacctcagtagtaacagaaataactaaggaactgagcagtagtgatgagctaagtaaaacagtccaattatttattttcacaatttaataataacatgaataaacaggtaaattccataaaggaatttaacggataaatgcagcaactgcaaaagtaaatgcaacttcacaacaatgtcactccatcactcagcactcaacactaaatacactcaacactttgcgcacactgggggtgtgtacagactccggaggggctcccaaagccctaatgctaaacacagacaactcatgtgctactattccaatatctggattcgcatggtcaactcacgtgctacacggacaactcacgcagtatggtatcaatacctggacccgcacgatcacctcacgtgctacgcggacaactcacgcgctatgatattaatatcctcacaaccaggccctcgccctcactcaatcatggacctcactatcctcaccatcatcaacaaataaggggacacatcccacatcaagtatcacagcatattagcaaataatagagactgaggtaaacatgtacaataattcctatgactgagcacaaataatgtgtgcatgaataaagcttaagaacgatctctaacatgaaggtcgacaagttcaacaacaaatagcggcgtaaacacaaatgatagccatcaggcctcacgagacggaccaagtctccatccctcgaggtatacacccacacacctatcacctagagtgggtatcacctccaaacagtcacacgatatcaaattctccgggtttatatcctcaaagcgagagttaaaactgttacttaaccgcataaaatcctactccgggatgccctcatctctggactaggtctccaaaatctctgaatctaaccgtaatcagattaataccatcaccatgtgctaaagaatcgaattctacaataaaaactacaaaatatgccaaaaatccaaaatcagccaaaacccggccccaggcccatgtctcgtaattagtcataacttgcagaatcataaagcttgtcctctactgagtctaaccatataaaatatattacaatagaactctgtttcgtcccacaaatcctcacttaaaactttccaaagctcaagccctaactccctgaattttactttgaaattatcaatcaaatataaaaaacgaagatggattcatgaaatataaccaaatccgagtaaagaacacataccccaatccatatggtgaatatttcctcaaaaatcgcccaaatatgagcaccctaactcaaaatatgaccgtatgaacaaaccctagttttatatattttttgccagctattcgggctcatttctcatgtcaaacgatcctgaaactcgtattttatgtcactaatggatttcttgtgaaattctagtcacgttaggcttttgaatcactcaatttgaccttataatgaatgagatatgtaggtattaatatttgcaaatagtgcagatttttaaatacgctgctagtggcaatttcgtaattaatctgaaaaatctagcaacctaattcttagtaaatgaccttaaaattctcatacaatgtccaaattcaacgattctttttattacgggtccataattacgatacgatctaacgcttcaatcaaaaaaagaaatcggagctcatttgttcaatatgatatcatttatgcttggagaaacggcgtcgaaacataagaaaaatgagcacaacacaacccaaacctatccaaaactcacccgaggtcctcgggacctcaaccaataattttaacaagtcatatctgtgagcacgtaattttttcttcacgaaaaacctactccaaaagaaatcaaaaaataaaacaaatttcctttgtgtacaattttgagaatttgcgtggcatttttggctaatcatttgtatttttatctgtgaatgtttattttatttctattaattaaaaatacaaaatatgttgcgtgtgaatttagaatttttttaatttattttaggattaggaattaattaagccatgtttggtttttaaaaaagaattgaaaataacaaaatgtgtaccttttgcatttttagcattttatgtccaattatgtgattgtgttttaattagtgtttaattttagattttaattattaagaatcaattagattttaattattaagagtcaattagtattagtgtttataaattaggaattaaaaagaggaaaataaaaataaaaaataaaagtaggaaaagaagcaaaaaatgaaaaaattaagaataaaatcagaattgggccagtttttaaattaaaagtcaggcccaaataggtgcgcaggtcggtccaatcttagagatggaccaaacgacctcgtatggtctgattcaatctgagccattgatctcctcagatcgaatggttcagtccatctcccccatcggcgaaacgacattgtttcaaaacattcaatcctgatcgttgtttaattcaatcgaacagtcaccaatcctcacccgttggccgacccgccttatgcccaaaccgacccaatcccccacttaaagaaacggtgtcgtttctattaagtttttgatctagaccgttgattttaataaatctaacggcctagattgaatttcttctttggtatataatactcaaacggaccccccccccaagtcaaacccccctttaccctttcgtctctaagctcagagaccggatgataacgccgccctcaaccaccgccctccacccaccgaaaatcgcttcacggcagttctggtgggccaaatgcccctatttttaccccagagatcccccttgaccttcccattccgaatccccactcctttatcttcgaatcccagccgatgttgtcgaatcttcgatcaaacattcagccagaaaccctagtatatctgacgaccaccaaactcacacctcttaacccttggacctctctcaccactagaacctcattggtttccctcgaattaccccggaacccctcgaataatgaatcaaagccaagaaccctaagcgccgccacatgattcccctatggcggcgctgacttgaaccggtcctagcaaatccaaggtgtcgttctgagtcagtggtcatctcaagactgctcaattttaaagtagtgcacttcgtctgttcttcataaagaatagacaagttgcactattttgaggttaaggaaaatctattggttggcattcaagtgtaagtgccctgttctcactgtcgtttaaataaacctttcattttctactcctttcttcttctccgaaatgtagataggtgtgtgttcgaatccagttccttaaatgtactgtaagttaattcatgatcatttttgtttgaaatttgttagtcatcgtcaatatactttcagtgttcttacattgtgtataggtttaatttagaattgtattaaatcatgccctgtatatgtgtcaattttgttaatctttgatcttagtggttagatataagtgttctaaatcattgaatccttgattttttttgtcttgagtgctatctaatttgatttgagtttcgagcttaaattgtgacttgagtttgatgaaccctgaatgttgtatgaatctgatcttcaattggttctgaatatgagtctgactttgatgaattaaaacttgaatgatattgattaggagttagcttcatttagcttcatagggttaattagttaattgttaggtgaattgtgaatggttatgctgaggtgttagagttagatttagttcatttagattaaattgaattaggaatcaatgtagtcaatggttataactgggatagggcagtagttcagattcccaggggggtagtttgggatttgaaaacctaaaagtggctaactaagtggcctgccaattgaatattcagtgaactattaaactaatgactttctttaataaaagaatgggctggaatgagtcaggagcgacatgggtattatcagggcattgtttaatttagaaaaaaaaagccatactgcttgtgatcagattcatactagggaatttaataacgaaaagactgaaactatcagcaatgctttagggaataacatggttgtaaaaactgaaaagaaaggacattctgaaaaggttgtgaaacatagtgcttgtaaggttgtaaagtgagaagcaagaaggctgaataataaaaagggtatgagagggaatattcagcaggaaaaaggtggaaacttggaataaaatagggattagttttagtccataaaaggggggagggtactgtttcatgggggaccggtttttgaatcctaaaaataatcagtaagagaatttagagttctggtcagttttcataatattctgaaaggtttaggagttctttaagcatccaattttgaagctaagtctgagagtttaaaaagaagaaagatcagagtttcttccagttttcatcagagagttttaactagcttttgaaatctaaaagagtcagaatttgagagtgataaactagaaaacctactgttccattggattctggtttgtttgaagtttcagaaattcattctgttcattttcaagcttgttttttgggtaattggttgcagtgttggagtcgatacatcaaccctgtttggtttaaaaattctggaactactggtgtgtttggttgttgttggtatctactgttgcactactgctgttgctatttgctgtgttacggctgttgctgaccttcctctcttcttcttctattactttcaattccaggtacactaccttgaatcactttgatgtatgctcattgaagcagaaatgaaatggccagaggatttattgttcaaactatagaatgcttgtattctatttgatattagttatgtgtttcctgttaattgaatggtagatatatgtataattaggattgcttttaaatcactgattggcaattaaatgatgtatgatatcggactactgaactgaatccttaaaatggcagtcagttcagtatgtgtgtttaattagagtaaactgttagattgctaaactattaggtgtgtgtctgtatgaatttcatagttaaatagtttcagctttgttagttcatattaatagaataaggtagttcaaaatcacattcaacttgagttgggttatgtagtagatattgaccacaacatataataatttgcaatttagcactcacttttagtttacataaatcaaaataagtcactaaatattgaaccagcttggactacacctaggactgtcttaggtagttttgaaccgttttcctcatacctgtggccatttgaattggtaaatagttaatattgagaatcgttgcgatttagtttattggtaaagtataactttgaactcacgaaaattggaataatgagttgaagtttgtgattttaagtcccgttagtaacaaagatccgcaaatcttgggtagaaataaaaatgaccagtaaattcgtagaatcagtacgccttgctgtaattgaagtttggttcgatgtagtaaagctaaggtcattaacccaataggcatgagttgagttcgaacaagacatgttaacgttcctttgactgtaatagattttccaagtgccgattaattttaacaaactttcgaataagcattagtgattgaggttagttctagtttcaaataattgtaaacaatgaattccaagtggttctgaatttcaaactgttaattccaacggtccaattatctaataatgttggtctaagttagagagagaataattagtctgttttgataaatatcgtttgttaatcgttctatttatattctcgactttagtaatattcactaatagaataaggaatgaaataatctccctttgtgcaagctcgagtgcaattttctgtttgcatttgtcataatccgataaataagttacggccttttcattcatgtaattaatttggacttttctttatctttagagacaaaaataagtagaaatgtagtcactttaggattgctcttttaaaataaacaagatgagtcccgccaaataaaacataaattgcaggaccctcagtagattgttaacttaaatgcttagatttcgagataggccgtatagcgaatttcacggcttttctcaaaataataacgcgttagcatctttaggtgcgtatttaataatttcatctccctaaactcgggtacacatttatgtgacccaaatccaaatctcaacgaagtcggaacatatcaaaaactgcgggtatatttatgtgatgcagtttgagatgcattctcaagacgttgtaattctcttaaaaaataataaatgataaaagtggttcaaggttaaaattggcacataggttcaaatgtataaaaatcagataaataagctaaatatgacagttgagcgaccgtgctagaaccacagaacccgggaatgcctaacaccttctcccgggttaacaaaattccttatcccgatttctggttcgcggactgttaatagagtcattttttttgtcgattcgggattaaaccggtgacttgtgacaccatatatctcccaagtgatgactctgaattaaacaaacaaatcccgttgcgattgtcctttaattggaaaaacccctctacgcccctgcgggcgcgggaaaaaatgaggtgtgacagctctggcgactctgctggggacaataacctagaaccactggttcagggttagaaattcgagcttagaataattgttgtatttggctttccttattatctgatgtttattacattttttggatttaatgtgcaaaatgctgcttattaccacttcgatattatgtgaactgtgtatataaactgctacgaaaccctttttctttctgagttttctgaaaaagggcgcatacgttcgcgtagaccacttttttgtaaaaattataccaaatagagagaggttgggaaagcgacaaggccgggcagacttgttcccgatacgtcgcccctcctctgccccagttgtccgctcgggttccccaagtctagaccaaaaccccaggtttttaaacctagtaaaacacagcttcatgtcggatccctagtaggaacgtttatttgcatcaagtgcatttgacttaggggactcaacacaggggttgggtccgtctaggacaagcaacctgaagtgaaaagaccaccatgctgcatcctgtttgttttatgcatttatttgcttcggactggcatgctgaccggcttctgaaaattggaaatactgaaaaatcgtaaaaaataaataaatatagcagtgtagagagatttttatgaaacaaatgcccaagtagtatcaaaactctaccgaaattttgaaaaaaaaattatttttttagtttaacttatttgaaaaacaaaagagaagagtcttattttcaagtttagttcattttctttgcctgaactacgctggtttgattctcaccaggtgtgagatatgtaggcaacccgtgtccggtccaacctcccctttgcaaaaatagccaaaaatgtcaagtgatgtcgttcttgtcaaaaatagccgaatgttcccgaaagggacgacggaaggctaacttagcataaacggccacatttggttattttggatttttgacctgttgacccacacagccttaaaagcttcgtccccgaggtgctaaaaggccgtgtaaatcgggtcttttatttttaatttgaaaaacaagaaaaagagttagtgggcaggtaaatgccatttggattttggttaaaataaactgaggcaacatcagtagtgttttaaaccattgttgcggagatagccttagagtatttttcaattgtcgaaaggctatttccgtaaaagaacagacaagcttgtgaagaatcataaaataatcctccccggcctcaaaattttatgtgaaattgtgacggggctacgtttgcaaaaacgaccattgttgctaacacaacaaaaaggggtccacatccgctgatcttagaaaactggtttttgcaaagataatttataagagtcaaccctaaccttaaatttccgcaggtacaaatgaataccgtccaggaaccgccgcaaatcgtcatagaaagggctcccatgcagctactgtgacgacccgacccgtcgtctcgtgagtaactaccgtgttcttcccattttctgcttccttatgtttcattatcagtattgggtgcgttagaatttaattggagtgattttattaggaaatgagacacttagtctcttttaagaaggcttaagttggaaaagtcaaccagatattgactcatgtgttagagagctcgaaatgtgaattttatggttcggatagcttcgttaggtgatttgggacttaggagtgtgtccggaatatttttgtcatgaccggtgtagaattaagcttgaatcggcaaagttagtattttggtgaattctggttgataggtaagattttgattcgaggctcggaatggaattccgagagttgctgtagcttcgttatgttattttggacttgtcaacaaaaattgagatcattcggactagttttgacgtgtttcggcatcggatgtgaaaattagaagtttcaaagttcataagcttgaatccgaggtgaatttggtatttttgcattgtttttagtgattcgaaggaacaactaagtttgtttcatattatgggacgtgttagtatactttgttgggatcccatgaggctcggataaattttggaagagttttcggatgatttttgccgttttgagcataaacgtaatgatctgaaggttcatttttagttctagagatccaaatttgattccgagactttcggaattttgataatgaattataggacttatctggaaattttggtctagtttcatcaagtcgtgattgggtttttgacgcgaaatatgagtaattatttaacgagcgaaatggatgccgcactgggcaaatgagctccgaattgagtttcgattgaacggttgtgttcgtattattatttgtgactcataggaacaagaatcttctaattctgagatcgtatgaaggagttagagcctttttagtgaaattaaagagtgttggtgcatcaggtttggtttggcacttttagcgaccagattagcacctttagcgaccagaattggatatttagcgaccagatttgcttattaaaaagctgctgcatttctgctcgttttttacctattttcttgcgaaataacacggcttggggcgaattttgagcaagaaatcatggaaaatcttgagataagtcacttgtgattatttctactccataatattgaattatcgtcgattaatccgactagatgacatatgtttgaggtgtaaattaaggattttggacctaggaatttgaaaataagatttgaagatttgagcggtcatttgaacttcgattttggtaaattttatatgtacggactcgtggcgagacgagaaatccggtgatgtgacttttataatttttcgagaagtgggctcgaggctcgggttttgccaacttcgtgatttttagcgtttatcaagtaatttcgattgggctatgttttttagcataatgtaacgtattcgttgtgggtttgattagattcgacgcgcgaagagggcgattcaagaggaaaagggcattacggactagcctacggccggttagaggtgagtagtcggtatagatgatggcctgagggtttgaaaccccagtttatcacactgtgacgctttattgaagcgtgactcacactccatggcaggtgcgggatcgtatatgattggggattgtgacttggtccatcccgagtgataattataatatattggcgactgatacgcatgttgtattgatgatatttgggcttgttgcccttgtttgagacctgttgccgacctgtagaacccttcgggggttgatgttatcattattagcatacttgagtaatacatggtttcagttcagagttctaaatactattttgcaaactcagccatatttctatgttttgaaaactcaaatgacattttaaatgctatttcgggctgatggtttttgttttataaatgcctaagggccttataacattctctggactgcatattatgacttgaaacagtggtatcaattggcattgtatgatataaattggtcaggtaacaatgactgaccattgcgcttgggctgtaggagcccctccaaagtctatacacaccccagtgagcgcgggtacccaaatagagtgggctgcacgctgcagcggtcatgtgcattgcattgcattcatacatatatacttgtctgatattgatctgctgttgtttcctcgttaattgtgataaactgttagctttagctttacattgtggcatttggggaattcttatcttcagacattatatatacttatttctcactgagttggtagtactcaccccgactcccttcacctcgcgtgcagttgcagatgttgctcacccggtagcgggttgctagctgatgaaggtactattattgttgttgtgcaaggtggccgtcagcgttcgcggcaccgtatttcatcctttgaattccagttggtactttatatttattactggccctgtagttgtattcagacttctcttgatgcccatgacttgtgacaccccggtcgggttgtattgggatgaaatcaatagttttaatgccattaagttgtatttttttttctattcattttgtgtaaatatttgttaaaaagaggatttgggtttagttggttggccttgtcttcacgagaggcgccatcacgaccgggtatggaaattgggtcgtgacaagttggtatcagagcctaggttactaggtctcacgagtcatgagcaagtttagtagagtctcgtggatcggtacggagacgtctgtacttatccttgggaggctgcagaacctttaggaaaacttcccattcttggaattcttatcgtgcgtacttgattcagcttggaatataactcttgaaattccttcctcacgtttgtatgcgcacatgagcgctcaacattatatgtgccttgatggcttgtaattcccctatcaagggtgagatgtgattgctatgagttgatgttgggcatgtctggaggacttgaggccgaatcttcgtctatggcttgagcactgaggtgccgattttgcaagctaatattagaaacctatatgttcggtattgcccctaattgtgggaatggtggcgggatagctacgtgatgtgtaagttggtgctgtgtgatgtgtctgtatgacttggaagtgtcgaagaaggtctgctaggtgttagatgaactattaattttttgatttccattgtgattggacgtgttaccctgagttgtaggtgcatggagaatcttttcaggtctcctagttgggagtgaagtaaatagcatgttgcgggttgagtttagacctaggaaggctaaatgactgtgtaacgtatatttggtggaaggtgtgctgaggtactaattgaggcgaagcaggtgggatatctcttgcggagtgttcttaaatggtatgatctgtgtgtgtatggtagaagatcgcatgtgtaactgaaaggtgtgtggtaaaatatgaaaatccgggtcgcttaagagagtggactcaattgatgaagagctgggtacgaggagtatagagaatttcagtactagatgtctggttttcacaaattggtagatgatttgaggttaatctcactatgcatggtggtatcatcagagtaagagtgttatgagttgttgagtgtgtcctgatatatggctctgagctaagttggggaggttgctgttgtttagctgattgcacagttatgtactatgtgattctgttttgaggtaggctggcggatcagttctagttgcagaaattgagccgaggatggcacaaatgaagtaaaattttgacaaaggttatatggtgcttcgtagcggggagaaataataggatgtctggtgttgttgacaaagaatgcttagtgtatagagaaggaagctagtggtttgtattagtatgagatcatgttttacagtgtcagggtgctataaggcacgagtggttgtgttcgttaagtcaggtaacttgcagttgaatgagagtgagtgacactcgagaatggttttattatgttcaagatttttgcatataataatcaggtgtcttaaggttgtgtatgtggctgaagattgtggtttcactagaaaaagtcaagacttgtggtattttatattaattatgggattctagtatcagcatctgcaaagtaaaggtagcggacttagattcgcaggaagttcttcagagtagggtattttagaatgtggtatttttgggaatagttgagagagtattcagtggactaagggtcatagttagtgtggtcttatattcgagttccatgtggcaatctcgggttgaggcattgtgatgctacgatgaggtggaaatatcaagttgatgatgaaacaaatagggaaattagatagatggaagagtttgctagtagaccgaatcggtatggcgaagatatgattaattccttgtttatgttcgaggtaatgagcccttacaggtattgggcggcagagcttttgagttcggacaacttgcttagactggtgtggatagaaagatttagtcctggcagtttagcttgtggttaggaaaaaggagatggagttctcaggttatcctagtatggtatggtatgtgtggtctgttgtggaggattgggatttgtgtgtgtaaggtacagttcagttccgaatggaaagtcattaaattcttaagcagcacgggtagctgcaggtgatttaagaatcgaccctcagatgattaaggaaaatggtattactattctagtgatttgacgggagtatacgttcagtaagaggggaaggtgatgtaaactgacaacacttcggtgggatttcggcagtttcctgttggaccaactattgacatttgagtttgttgatggcacaggaaaattttagaatatctttcgtggaatgaatgggtacttgatgtgtaatatgtattcatatgacaaaatatgggatcaggtatagtgatttgtgtgttatatggagttggagactgggagttctccgatacagtctatgtcgcggtcaattaggatttggaggctagagtggatctttatttgttgatatgttagattttggacatgattttgggtgttgactggttgtctcagtgttgggttattctagactattgtgctatgggctaggtcaaaaaatgccactagttgcgtggcgaggtgcatcagattatgttatagcaagagtggtttgtattccaaagatcaccggacggccgggaaggatttactttcttaattaggccttcgtggcggatgccagtgcagaggttcttaccatcgattcagttccggtattgagggacctttcggatgtgtttcttgtggccgggcatgttgccgggtgagattgtggatttcggtatctatttggtgtcgggcatcgtatcgtgcggctccgacataagttatagtagtggaagaagcagcgtcaggcttcttggtaatgagtttgttggtaagctgattcgatacgtgtttagcttgagttggcttggttagtcccgaatcgtattgatgaaggataggttgattcgatcgttattgaacctgctagtgatctgggagatcgatgagttgcttttctgtgctgtaagacgctatgattttcggacggtggcacatatattgcggtgctatcgggatttatagtagaagttgagttttgtagcttacaacgctataagtagatatcattatgcactcagtgtgcttacgaccgatactcggtatttagttataatgagcaaatttggctcgatgtgcatcttcctatgcgagatagttgtgtggatggggtggcacaccgccacgggcacgttatctgtatcgggttgcgtgccgcaacagcgtgatgttgagattagttttccatatgtttcttcgtgtgcccttcttcctggtttctgagtaaagtctgtattgggagttgctcggcgaataacgcatcggttgtgttctttcaggactgaatggtgtatattacttgcttcaccgagggtgtgatggattgcttggtttcagacatcaatctgtgcgtggctgtctattttaggcatggtgacttgaggtgcttcatggtaacggtgtttggataggatcgtgcgttatggcgaggccatgtggagttatgacctttcgatgcggattcaggtactctattactatgatgtgagacggggtctcagcttcgtgttgtaatggtattgaggagcttggggtacagctctttcgtttgagtcattttcatgatttgagtatgttcagaccgtcttttattggtgcgggtattatgcaagtcgtggcttaggccggtgttgaggtgtcatgccaccagagtggtgtgctggaccgaagtgatggctggggacattaatgaatacgaacggattgggtttcagcttgttggaaggttaatatcgaggttcagctcgtaaaaatctgttgtggtagtagtcgaaagggaagtgaatttcatgaatggttgatctgagaaattgttatagtttatggcgtgttccatttatcgttggcagtatatgaacgcgttggaatgagactttagctaaataagaggctttctattggtatttgggtattgtgggcaactgttgtgaatagagactatcgttccgagtgttggattgtggggtatattgtatgatttcacctgaggttgcaggtgtgggttattacagctggttcgtgttaattctggtatgatttcggaaagtgcaatgtggttctatggtttatggtctaaatggctgcaaaatttcagttgtattgtattatcaggcctatgtgagatagggtgacgtgagttcatccccgaatttatacatggtaaggttattcagcaattgttgggcttttggaacaagtttgggcacgttcgaggacgaacgtttgcttaagttggggagaatgtgacgacccgacccgtcgtctcatgagtaactaccccgttcttcccattttctacttccttatgtttcattatcagtattgggtgcgttagaatttaattggagtgattttattaggaaatgagacacttagtctcttttaaaaaggcttaagttggaaaagccaaccagatattgactcatgtgttagagagctcgaaatgcaaattttatggttcggatagcttcgttaggttatttgggacttaggagtgtgtccgcaatatttttgtgatgaccggtgtagaattaagcttgaatcggcaaagttagtattttggcgaattccggttgataggtaagattttgatccgaggctcggaatggaatttcgagagttgctgtagctttgttatgttattttggacttgtctgcaaaatttgagatcattcggactagttttgacgtgtttcggcatcggatgtgaaaattataagtttcaaagttcataagcttgaatccgaggtgaatttagtatttttgcgttgtttttggtgattcgaaggaacaactaagtttgtgtcatattatgggacttgttagtatactttgttgggatcccatgaggctcggataaatgttggaagagtttttggatgatttttgccgttttgagcgtaaacgtaatgatctaaacgttcatttttagttctagatatccaaataggattccgagacttctggaattttgataatgaattatattactgatctggaaattttggtctagtttcatcaagtcgcgattgggtttttgacgcgaaacatgagtaattatttaacgagcgaaatggatgtcgcactcggtaaatgagcttcgaattgagtttcgattgaagggttgtgttcgtattattatttgtgactcataggaacaagaatcgtctaattccgagttcgtacgaaggagctagagcttttttagtgaaattaaagagtgttggtgcatcaggtctggtgtggcacttttagcaaccagattagtacctttagcgaccagaattgggtcttttgcgaccagagttgcttattaaaaagctgctgcatttctgctcgtttttttacctattttcttgcgaaataaaacggcttggggcgatttttgagcaagaaatcatgggaaatcttgaggtaagtcacttgtaattatttctactccataatattgaattatcgtcgaataatccgactagattacatgtttttgaggtgtaaattagggattttggacctagggatttgaaaataagatttgaagatttgagaggtcatttgaacttcgattttggtaaattttatatgtacggactcgtggcgagacgaggaatccggtgatgtaactttcgtaatttttcgagaagtgggcccgggactcgggttttgccaacttcgtaatttttagcgtttttcgagtaatttcgattgagctatgtttctttagcataatgtaacatattcgttgtggttttgactagattcgatgcgcgaagaggtcgattcaagaggaaaagggcattgcggactaacctacggccggttagaggtgagtagtccgtatagatgatggcctgagggtttgaaaccccagtttatcacactgtgatgttttattgaggcgtgactcgtaccccatggcaggtgcaggatcgtatatgattggggattgtgacttggtccatcccgagtgataattataatatattggcgacttatacgcatattgtattgatgatatttgggcttgttgcccttgtttgaggcctggtgccgacctgtagaactcttcgggggttgatgttatcattgttagcatacttgcatattacttggtttcagttcagagttctaaatactgttttgcaaactcagccatatttctatgtgttgaaaactcaaatgacattttaaatgctatttcgggttgatggtttatgttttataaatgcctaagggccttataacattctctggactgcatattatgacttgaaacagtggtaacaattggcactgtatgatataaattggtcaggtaacaatgactgaccattgcgcttgggctgtaggagcccctccagagtatgtacacacccccagtgagcgcgagtacccaaatggagcgggctgcacgccgcagtggtcatgtgcattgcattgcattcatacatatatacttgtctgatattgatctgctgttgtttcctcgttaattgtgataaactgttagctttagcttgacattgtggcatttcgggaattcttattttcagacattatatatacttatttctcactgagttggtagtactcaccccgactccctacacctcgcgtgcagttgcaggtgtttctcacccggtaacgggttgctagctgatgaaggtactattattgtagctatgcaaggtggccgtcagcgttcgcggcaccgtatttcatcctttgaactccagttggtactttatatttattactggccctatagttgtgttcagacttctctagatgcccatgacttgtgacaccccggtcgggttgttttgggataaaatcaatagttttaatgccattaagttattttttttcctattcattttgtgtaaatatttgttaaaaaagaggatttggggttagttggctggacttgtcttcacgagaggcgccatcacggccgggtatggaaattgggttgtgacaactacgtagttggtggggtgatctagataaagatggccaagtttgggtgaagaagaagttgggtcccttgttagacatcctgcacatcaagccacgggatgatttgattaaggctttggtgaccttttgggatcccgttaacaatgtgttccgtttctcggatttcaaactaatgcccaccctagaagaaatagctgggtacattgatttcggccaagagttaagaaagcagcagcttatatttcccagggctccctcggtacacaaattcttcgatcttttgaaaattagcaagcaaatgagtaacgaccgagcaagcaacgagagttgtaagttctgcttcttgtattacaggttcggacactcatgacaagggtttgagtaacaaacagaacaaaggcacatgggagattcaccgacgatttactttcattgtagcattcttgggaatcatggtgtttccgaattatgaaggcacaatagatatccttatggccaggatcgcacatgttctcatcgacaagaaagataacactcgggcattaactttttgcaaatctggggctcagtttttcgaaggttgcagcattctccttcagatgtggatgatcaaacacattcggcatcaccctaagttcatgagacatgcctcagatgggaacaatttcatcaagaaatatgaggaaagggtggaagattacaaacccctagaggggtttgaatcatgggtttcctatttgagaatattgagagcggatcaaggtgaatggaccatagggtggctcccgataacagaaatcatctacatgactgcgtcgaaaggctacctaatggtgatatgagtgagaagtatacaaccgtatgcgccacaaagagtgttgagacaacttggaagatatcaggtgatacctgaggagatagacctgagcactcaagtcattgaactacacccagaggcaacgatccccgaggctttggtgaaaagagattggcactgttgtcagtatctaaaaagtaacaccctggtaccggacccgactaaaggtgaggttgatcccaattatgccgattggtttaagaggaactttcatgtgaaccatgaaccggaaccggaacccgagcccgaacctgttaggcctgctaaaaggccccacattcaagcttttgatgacaaaattcaagaaaggttagcttggggggggggggggaaaggaaaaagaatatcaggccaccatctgcaatctgcgagaagagttaagaaatgccaccttcaacaacggtttacaggcacaagaggccgagggagagagaaaaagattgatttaagaaaatgaggctctcagggcccagattcgacagttaaggatagccgatgagaatccgggccgaagcgggaaagatggatgactcatttataaccttactcaaaaggtgcgtgactatgaagatggcctcgagaaagctgagtctgaactagcaaaggcacaaaaaagattgactaaagatgccgagggacatgcagccttcattcagcagttgaaagaaagatatgaaagaggggccgcaggttggaaaacgacgattggcaacctaggaggtgaaatagctaaacaatccaagaggttcaaaaccgagagggaacattgttatgccacaatggaccggttggaagtagatctatgccacttgcaagagcaaaatcacaccaccactcaggtcttagaggctagatcccaacagatcgatcgcctactgtgagaaaagggcattatgagaggtagggtcgaaaggattgccaactacattgcgatgaagtgctgcgagtgtgaagacatgacgagatccatgttttttgccactgtaatgatcttcgttcggcagataatggaagaactctatcagttccaggaagacatagcaagcaggcccgctgcaacgccaggaggtgttccaagggaagggttggaggcattgatgttttcttgattgtacttcctttcgagtctgtatttttgttttttagaacgcatgtttcgagtctgtttttgaattttcctagaaaggcatgtcccgagccttaaagtcttagaaaagtatgttttcgggtattttgtaatttagtactaatgaaaaaattgaaaaccccaaaaagttgctcgtttgttttttgcatttaccttttgaactacgatatgatctgattcacatggcatcgcgatacgtaggcaatcctcatcggatccagtcatgagtctctatgaacaacttaaataaaagaaaaagagaaagtgaataaaaggaaagaaataatggaaggtttcagaaacacttgaaaaaggcacaaataaaataagccgggatgatgcatgcggtcagagcaaagacatgttagaaatggttaaactacctaggaacattgcatcaccaacgtgcaattgcaatatgtgttaaaactctaacgctgacaagtttgttgtttttgtagttccaaccagttagtttgttagaacgtactggcaccataccattatcaaacaagatctaaagggcccataccaaaaagcatgactaactcagaaaatagtgttgaggaggaaaagacggaaaatcagaagctgaaggaggcaacggaaaaaataagactggagatgaacgaaatgcagctagccttggctagggtacaaaagggccccaaccctcccgtgactcctactctcccaccacgacacacgtcggaataccctccccccggcccttcaacaagcttcccaagtcactactactatcagggaagaaatgcctatgatccccagctccatcgcctaatcagaaccttcccccaccaaatgttcctgttttcgtggcacccccaccagccacgctacaaagatcatccagtgagccgttgtttcagactcacgataaccaatattacccccctgaacctacattcaaagcacccgagccacatgcctataatccccactttgaggtcccgacatagattgaaaagccggctaagagcccagagcaggacgaagtgcttcgaaaaattaaaagcctggagcagtccttcaagaataggcacgggttaggcaaccatgtcaacgtggcctacaaagatctatgtccttttcctgacgttcaattgctggcagggttcaaaatgccaaagtttgatctatatgaggggcatggtgatccaatggcatatttgtgaggtttttgcagcaagataagaggagcaggtggtaaagatgagctactgatagcttactttggtcaaagtctaagtgggtctgcactggaatggtacagaagataggatcctagcaggtggtacacctgggacgatctagcacaagcatttgctggtcacttccagtacaaccttgagattgtccctgaccgtctcacattgctgaaacttgagaagaagccgggagagagctttagggaatttgggttccggtagagagaacatgcagctagagttgatcctccaatgagagaggggtaaatggtggactactttctgcagactctagagccaacttacttcggtcacttggtgacgtcagttggaaatctttcatcgaggtcgtgaaaatgggcggtatgattgaagaggtacttaagtccaacaagatcttgagctattcggaaattaaagcaaccactcaagccatccagagcagcacgggaggtgcgctcgggaaaaagagaagagaagaggtcgcaacagtagaggcaggtacttggtccaaaacgagaggtccttcccctcgctaccaatccagaccccaccacccaaattacccatatagccctccacagccctactacctaccacaagaacaacatttctccatccatcaagcccagacatacacccagcctccggctcacccgcaatggcgcgcgccggctccacaaaacacatatccacctctacaaaacacatatccacatcaacaaaacatatatccaccaccaagggcctgcaggaacccttcagggtcgggtttccgggggaatcaggctttcaggaatgaaagggtgcaaaggtagagaaccttcactgagttgggagaaacctatactgctctgttccacaaattgaggcagttaggcctgttgagtcctgttgagcccagattgccaaatccccttcccaaaaatatggaccgctcgctaagctgtgaatattgttcggggtctcccggacacgatactgagaagtgttggaagttgaaaaatgcagtgcaagatcttattgacatcaataggatcgaggttcaaacatcagaagcacccaacatcaatcagaatccgttgccagcacaccatgaagcccacatgatcgaacttgtgcacgatggagaggagctaaataaaccctcacagacagtaatgatgatccgttctagtccaaaagaaaagtcgaccagtggaagagaggtggtacagttggagaaggtagacgtcaagctagtgcaagtgatgggaagagttcgcctattgttgcaaagaatccagagccggtcaaagtaacagtacaagggagaccaagccagccagcatacatagggccagttgttctcaggccagtaatgcagttactgataatcagcgagaaagccgtgccttggagctacagtcaagcgatggtaatgtataaggggaaggaggttgcggaagaagtatgtgaggcccaggggttaactcgttcgacaaggtgttttgctcctgccgagttaagagggtccaacccagcggtgataatgaggccagtgacggaggaataggcgaaggagtttttgaagaaaatgaaggcacaagactactccattgtggagcagttgagaaaaacctcggcacagtttttgttgctatccttcttgatccattcaagcgaccattgccaggcactgatgaaaatcctgaacaaagcccaagttccggataaaatccctgtaaaccacttggagaggatagtgcacaaaatcttcgaggtaaactgagtgacgttttccgctgatgaattgccagtagagggtactgaacacaacaaagccctctatttgaccgtaaaatgcaaagactcattggtcactcaagtatttattaacaatgggtcaagcgccaacatctgtcctttgactactctgaacaagctgaaggttgatcatgaccagattcacaggaatatcgtttgtatccgaggttttgatggaggtggtactgacatggtgggtgatatcatactggaattaaccactggtccagtcgaattcaccatggaattccaagtggtagacgtggcagtatcatacaatctcctattgggacgacccgggatccatgccgccaaagtagtgccttctacattgcaccagatagtgaaatttgagttggataggcaagagatcgtggtgcacggggacgacggtataggcactgtaggtgatgccattgtgccattcatagaaaccgataatgacaggggtccatgggtgtaccaggttttttatgcggtctcaatggacaaaattcctgagggcgaggaccttccacttcccagaattgcagctgcgaccttcatgatagcctcgaaaatgttaaatagcgggtttgtaccaggaaaaggtttggggttgatctgcagggtattgtcgagccagtttctttgcctaaaaatctggatacttttgggctgggattcaagcccacaacagcagatgttagacgggctcaaaagttgaagaagagagtttgggttcttcccaaaccggttccgcatctctccagatcctttgtcagagcaggtatcagaaggttgtcaatcccaaaagttctcggaccactgattgggtcagatggagatctgaatcagggttttgaaaggctgttcgccgacatcaacgtgatagaagctggagaagggcccagtagggcagatgtacagtttgtggagcctagggcaaatatcaacaattggacggctactccccttcctacccggagggagtcttggtagtgggctctgatttttctttcttgttttctggattattccacggttgtaatccagtttttgttttatttttgtattcggcaaaagtgtgaaactctgttatcccgtattttaataaagtgaaagtttcccttcttattttgttttcttcttttctctttctgaacagttctctttatactggttctaatgacatggcatgcacattggatcttcaacctagtctaaaaaatcaatctgattccgaactaattgtacaagtggtcgattatgatgatgaatcggaatacgataaggatgaagccttcgaagagataaacagagaatgagccaatttgaagagaaatccaagcccaacttaaatgacacagaatccatcaatttaggggatgcagacggtatcaaggaaactaaaataagcatccacattgaaccaaatatcagggaagaactaatcagaacacttattgaattcaaagacgtttttgcatggtcgtatgatgacatgccgggtttaagcactgatttagtggttcacaaattgcccattgacccggcgtgcctgttgcgaccaaagacactcacgcaagtgcacgtgatcgtcaagtaataaagtggtgagtagagtatcgttcccacgaagacttatgactagcttgcgactgtttcacacacgagttctttatctactcgagaattcgttcacaaaagagaattgattgttttactaactaatgtctaccaaattattctatcaaaagcaagtaactaatcaaatagcggtttcggttaacaaacaatagagagggatattccaggttcacgggcatcagttacaatcatgttctttcttaacttcaaacgactaatcaattaatctgggttattgattgacaaggttcatgttactcgtaagaatctgtcgagttcttactcgcctattcacgtcagctcaatgcctatatgtctatggaatcaagattaacgagaatgcatttacaactcttatatttcaaccaagcaaggcaattgggtatatgtctatcccaattgcaaatccattccccgaggcccgggttcaagaacctgctctgttcaattctatatgcaatctaaagttcccactttcgagttcaactagagattcgtagatagtactttactgttagctactcagcaaaataattaagatcaaaatcaaataaataacccaatacaataaatcaactttgtcgaattaaacttcaaacatcaacagtcatgtttttacccatgaccctagaacaatgagttctagccactcatactattgttcaacatattaaggtttaatatcatcacaaatatcaaagcaaagagaagaaagtaagaacttgatgattcaaagccctccttgcctcttgcctctctatttctggcaaaaccttatgaaaaccttgataatttgaccttgggcgagcttgactttatataggttatgtggctttttcctccgaatttccattttttccctttttcacaatattcccgtcgcttggacatgcgcgggcgcgcacttggccgcgcattaggccgcgcatgtcactggaattttttgtcaggacacgcataaatgtgtgggcgcgcatttggccgcgcatgcccaggtgttcattcttcactttttttcttgtctttctttgaacatattccgtcccgacaggtttttgcttgctcccaaatggttccaatcgacattcttttgcacatactaggctccttaatctgtaataagtacaattcacaattagagcccatactttatcaattaatcataatatgcgatcggaatataatcaggtagaggcacaaacaatgcctaaatcacccagatttcgcctattatcaacaccccacacttaattcattgctagccctcgagcaatcacattatactctctagacaactcgccactcaaccattccctttagcgtgttccacatagaacaatatacatacattgcgcctagcagtgaacattcattgcctcaaaacagactcttaggggccacgtaatatttacacttcttcaaagcactttacacagaagtcaagacttgctttactatcaagaatcatatgccctctcatttatatcatacaggtgaattcattttgcacaattgagtcaaacactcacatatatcaataaagacgctaactctcacaaataaagtcacatgcatgcaatgggtaccataagcttgtccttaaatctccactaatgtaggttagctcggctcaaaatcagctaggactttttcatggttgtaatgtgggctaagggacgggtaggataactttaggaatagtggatgaccctcctaagcactttaacacatcacataatcacttttaaccgcaacttattcagtctacttcactttcacaaacaatatcaccccaaaaatgctcccttcttctttaagcactacattgattcatacccactagcaagaacaagacaacaatgtattcatctcattttttttttttttcaatttccgctagtggtgtattattttacaaaataagtgcacatttctttcttttattggttccactcaaaagccaccccactcttgattccttctactgttcttttagcactcatctcaccattaaagtgcttcaagaggtaagggatcaagattatatcaacaaaaaataaaggggtacaagcttgtattatgggtgccaaataaaaagtcttcaggctcaaaagggttactagggatgaattttgtttgtgcttcgcaactaagctcaataaagaccaaagaaagcctaaaatcatttctcaaaccgagcatcacctaatatttcgcttcgactcacataccgggcaaattctagacacaaatacaatacatggactacacaattactccccacacatggcatatgactccgtcagatcagctcatcaagacattctatttcaagcactcgaattagtggcaaacacacaaactaaggccctttttaacacgatttagcagtgaggtctatgcgttacactctagggtctattgtgttcaaaagtgtcaacgctaagggttctcttttagttcctcgctcgtagcccactactccaatctacaaatcaaaaattataaactacctatgcctggttcaagttaaacccttggaaaagaaccacggcctaaagaaaaaccaaggggggaggtgttacactacctagaaagaaaataaaaaatctttttgttgttttctttagactctttccctcaagaatcttgtctaaaggaatccgtcatagggacgagtctacatatttttcgatttttttccctatattctcgactcatctccctcaagaaccccttcgatagggatccgtcatagggacgagctgtttatctaaactaattaacaaacgactcaacaaactaatcactactaagggaagaaaaacaatctaacaatgcaccaaacctatcaaaaccaccaacctatcaaaacaaccatctgtacaccaattacaacaaacaattagggaatcccccaccccacacttaaagagaaagacatgtccccatggcttaaaaaaattcaaaacagtagtgaggtgaaagacttctctgaggtatcactcttggtcagaaacggtgccagggtccacgtggcacgcacgccccaacgctcgaagccagcccataaactttctttctgacttctcctgcttctcagtgagcgcatccacacggatccccaagtctgtcatagaggtccgcagaccagccatctcctgctccattgctgcaaactgagacactcgggctacaccggacgatgtctcagcctcagagggacctgtagccgccacattctgctcagggactagcgcatcctcatcctcttcagcttcttcttcctcgtcaccagaattcactgccgctgctacctccaccacatccggttccttgcctatggtcaccttatccacccgaaacgggtcttcctttatcactaaaccatccaccacttctttctacggcacattggctaacccgcacagctgagtgactaaagaaggaaaaaagaaaccatacctcctcacccgactacgaacaaacatctcatcatggataacattggccatatcaaagtcgtgaccgttcacaaagcaccagatcagggcagcacggggtgcattaacctccgttgtgttgtgcaatggatgaggcggttgttgatgatgtacaaccaacacttagcttcataagtcagcgcggcggagtggaacttctctccactggggaaccaaaccactcgtttgccaggaacacagatagtctcaaagaagtatgcccatttttccggtgtcgggttgcgaccctggacataaaaatcatcatcttcattaagagctgcaggcaactggtaagcagtccaaattgcctccacagaagcattcaccaccctgcggcgcacagtgacaacccaatcattgtgttccgggacgttggcgtaaaactttctcacgaccatgagattgccttccccaggttcgtttatgaacgtttgcagtccccgccatatcaactcctcgtatatacgaggacagcacctttggagtctcctaatgtctatgcccttttccggaattggcttcctgagagccttgtccacaaatcgaaactgagccctgggtgagacaaattttgtagcatcatagctgggcattgatgcagcccctcttgctcgagacgagctggcctggctgctcgtggatgcacctgtagcacgtcgtttcctggagagagccatattagctgtaaaaacaacaacatgttagcataatccaaatcgggttagtgaaacaatgcggttactcagacttcacacgcatctctagcccccaattgacatgctcatggtgattggggcattcccacaaacaccttgtgagcattgggccttcaccattcttttgaagcttatttgggtatgacacccctccaaattcactcttcacatcacaaatagaggggggtttccaccctacacttattatgcactacattcccaacaaagaacacccaactctaaacaagaggctaactccaatcactacgacaaactaaactaacctatgcacaaaatctgaaaaagaaagaaaaaaaaagaaaaaactacaaaataaaactaagaagtagcaaaaagggaagagtaaagggtgaacttaccagcggagaaggagtggagaagatgaggagggggggtcgtttgcttgagcagcgggcaggggggtaagggttttttttggttttgtttttgttgtgggggggggggggggggggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaggggggcagcgggtgggttttgggattaaaaggggaacggttatagatgaggggaatggaaattaaaagaagtaaaaaaaactaacctaaaaacttaaaaaaactaaaaaaacaaaagctcaacagaaaaaaaaaaattaaaaatcgccggattttggcccaaattcgcgggcagtgcgcgggcgcgcatgccttccagagagtttggcccagaatgcacggccaggtgtgcgggcaagtgcgcgggcgcgcatctgggctttcatttttcacttttttttaataaaagcttaaaccttacaactaccattgggttgcctcccaaccagcgccttatttaacgtcctggctcggctgttacctgcccttaagcatcttgcaggtccactgaggttttatgacatgcaaagtcaccaccccagtagtgtttgattcattgttcgtttaccaagaaggtacccgttgagctcatctctctcaattctacagctccatgaggtttcacgctcaccacaacaaagggaccagaccagtgagatttaagctttccgggaaaaagcttcaacctcgaattgaacagcagcacttcttggcctgactcgaactctcggcgttgaatgtgcttgtcatgccacctcttagtcttctctttatatagcttggcattctcatatgcatgcaatcgaaactcatcgagttcatcaagttgcagcaacctcttatctccagctaagtctgcatccatattcagcttctttattgcccaataggccttgtgctcaagttcaacgggcatgtgacatgctttcccatacaccaatctatacagggaggcacctatgggagttttgtatgcagttctatatgcccacagtgcgtcgtctagcttccctgcccaatcttttctgtttgcacttattgtcttctcaagaatttgctttacctctctgttcgacacctccacttgaccactcctctacggatgataggcagtggacagcttatgcttgactccgtactttgagaggacattgtttaacagtttattgcagaaatgtgtacctccatcgctgatcaatattttgggagtcccaaagcgtgtgaagatctatttcttaacaaagctcaccaccacctttgcatcattagaaggaagagcaatggcctccacccacttagacacgtaatcgaccgccaccaatatgtatctatgaccatttgagtaagggaagggtcctatgaagtcaatcccccaaacgtcgaaatgctccacaaccaggatgttctgcagtggcatttcgtgcttctttgtgattgtccccgttctttggcacctgtcacacattttaacataggcgtgtgcatccttaaacagtttgggccagtaaaaacctgattgtagcactttttgggctttccgatctcctccatgatgacctccatatgctgatgcatgacaactgtcaagtatggctttcatctcttcttcaggaacacacctctagactaactgatctgcacatagccggtataggaatggctcatcccatatgtatagcctcacatcatgcaaaaatcttctcctgttgtctggtgataattccggtggagtcaccccacttgcaatgtagttcatatagtcagcataccaaggagtcgtgcttgaagtgattgccaacatctgctcatccgggaaagtctcctttaattcacccccttcagccacgtgagctcgatcctccaatctagacaagtgatcagccacttgattctctgtccccttacggtctcgaatctctagattgaactcctacaataacaggacccaccgaatcagtctcggcttggcgtccttcttctcgaacaagtacctaatagctgaatgatccgtgtagacgatgactttggtccccacaaggtaggatctgaacttgtcaaatgcccacactacagtgagcaactccttttccgtgacagtgtagttcatttgagctgggtttatagttttgcttgcatagtagattgagtggaagatcttgtctttcctctgcctcaaaacagctctaacagctagatcgctggcatcacacatgaactcaaagggttggtcccagtccggagcaatcattatgggtgcagtcacccacctcctttcagctcttcaaatgccgtcagacaggcatcattaaacttaaaagccacatccttctcgagcaacctgcacacgggagaagaatctttcgagaagtctttgataaaacgacaataaaagcctgcatggcccaagaaactatgaatgccttttacagaaactggtggaggcaatttttcaatcgcttccacctttgctttatcaacctgtaaaccgtctctggacactttatgtcccaagactatgccttcgcgcaccataaaattacacttttcccaatttagcaccaggttagtctcttcgcacctagcaagtactttctcgaggttcatcaagcagttatcaaatgagcatccaaaaactaaaaaatcatccatgaatacctccataaacctttcgaccatatcgataaagatggccatcatacaccgttgaaaagtcgcggctgcattgcaaagaccaaatgggcattcgtttgaacgcatacgtgccataaggacacgtaaaagtggtattttcttggtcctctggggctatagcaatttggttataccccaagtaaccatccaggaagcagtagtactcctggccagccaacctgtctagcatttgatcaataaagggaaggggaaagtggtccttccaagtggcattgttcagttttctataatcaatgcaaatacgccacccggtgacagtgcgtgttgggattaggtcattattttcgttcacaactacagtcattccccctttcttggggacagattgtacaggacttacccatttgctatcagagataggaaagacgatacctgcatcaagccacctaatcacttcttttcttaccacctccttcatgattggattgagtcggagttgttgctcaacactaggtttatgtccctcctccatgagaattttatgcatgcataaagctggattgatgccctttatgtcagacatcgtccaccctagagcacgcttatgctcacgaagcactctcaatagcttttcttcctgcaattcagataagttagaagaaacaataacagataatgtgtcagactcacccaaataggcatattgcaggtgagaagggagcggtttaagctctaactttggtgcttctttgattgacggttttggggaaggtccctcaggcctgtccaaaggttcaaaggggtgtgtcccctgcacatacgcacaagatgtgtcaaggatgtgcatcatctcctcgacctcctcgtcaccccccaaattgtcaaacaacataagtactttctctagagaatcgtctagataggcacttggatcacacacttgctcgtcaagttctacaaccgagatcttggagagttcttcatagtgacggggaagctgaatcgctctgtatacattgaaaactgcctcctcatcttttacccttagaatcatttttccctctctcacctttataatagcgtcacctgtcgccaagagaggtctccccaatattataggaactagctcatcggcctcatagtcgaggataatgaagtaagctgggaatatgaatttcccgatctgcagcaacgcatctttaatcaccccttcagggtatgctatcaacctgtcgggtagctgaaacatcacagtggttggtctaggagctcccagacccaattgtttgaacagggataagggcatcagatttatgctagcccctaaattacagatagcacgacccacgtcaatattaccaatgcgcaccgggatcgtaaagctgccaggatttttaagcttttaggaagcttgttttggaccctggatgtgcactcctcaataagtgcaactgtttcaaattcattcaatctcctcttatgagccactatgtctttgatgtatttagcaaagttagggatctcacgaagcacaacaaccaatggaatatttaattgtacctggctcagcatagagaggaacttgctaaacatgcgatcatcatttttcttcgcaagtctctgtgaaaaaggtggtggtggtctcgggacctccactggcttgggattctcagtagctatctctggctcttttgtcactttagggatcaactctccctcaggtacagggttatctctccttttcttgggcacttcctcaagctctcttccattacatagtgtaacaacatttacttgtggatttttctatgtgtcactggggagggcacctgcaggcctagtgttctggtttgtagccaactgccccagctgcctctcaagattcctgaagtctgttctgagctgctgattgtcattcctcatctgctgattttcagttattatttgctgagtgtcattcaacaacttcttcaacaaatcattggtgctctcttccatctgctgaggtggcttttgaggatgattgaagcccccttgaggtctgtgctgattctgaccctactgatttccaccccatgagaagttagggtgatttctccaattcaggttgtacgtatttccatactacgcatgctgatttggtggacctctgctcttttgtcccacgtagtagatcgattctggattttgtggggcacatgtcactcatatgattatcaccatatagttcacagcaaatagccatctggttcacgtgttgcataggctgtggtggtggctgcattgccattctagtcatctgatttgacagctttgctatttctgctctcatagccgagacctcatcttgttcaagtactccagctgccttctgtttcacttctcttcgtgaatctcccttaccctgccagttgttataattagctgtgaaagtagtgagcaaggtctgaatttcactataaggtctggccatgcaactacccccacatgctgagtctagattcatctttgaagcatcatctaacccatcaacaaacgtatgacccaacacctcgtctgtctgacaatgatgaggacagtctctgagcatcttcgtgtatctttcccatgcctgactaagggtctcgccaggttgctgttcgaacgcaagaatttgactcctcagcacttttgtcttcctggtggggaagaacttgattaagaattttcttgccagatcatcccaagtgtggattgaatttgctggttctttgtttaaccattctttagcatccccgatcagtgagaaggagaacaatgtcagcctgacgtaatccttgggaacgtttggatagttgtacgtatccataatttccaagaaagtctgaacatgccgctgtggatcttcatgaggtagacccataaacaaccctgcattttggatcagctgcaccatatattacttcagctcaaaatgcctagttatgtcaggcttcacaatagcctgagtcatgttagccaaactaagtcttgtggcttcaataaccgcccgttcattattacctgccatctcaattggctgtggttgaactacgatgtccaactctctttcaattctggttctcgcgtccacctccctcctcaacctgtgaagtgtccgttcaatttctggatcgagaggaaggagattttttgcgcttctacttcttcacattcaatagaaaatcatgtattagcacaaacaaagtgaactgatagttaaatctcgaataaataaataatcaaagtccaattcagtcaagtagctaatttctatgtccccggcaacggcgccaaaaacttgttgcgaccaaagacactcatgcaagtgcacgtgatcgtcaagtaacaaagcggtgagtagagtatcattcccacgaagacttatgactagcttgcgactgtttcacacccgagttctttatctactcgagaattcgttcacagaagagaattgattgttttactaactaacgtctaccaaattattctaacaaaagcaagtaactaagcaaatagcggtttcggttaacaaacaatagagagggatattccagggccaggggcatcagttacaatcatgttacgttcttaacttcaaacgactaatcaatttatctgggttattgattaacaaggttaatgttactcgtaagaatctgtcgagttcttactcgcctattcacgtcaactcaatgcctatatgtctatggaatcaagattaatgagaatgcatttacaactcttttatttcaaccaagcaaggcaattgggtatatgtctatcccaattgcgaatccattccccgaagcccgggttcaagaacctgctctattcaattctatatgcaatctaaagttcccactttcaagttcaactatagattcgtagatagtactttactgttagctactcagcaaaataattaagatcagaatcaaataaataacccaatacgataaatcaactttgtcgaattaaacttcaacaatcatgtttttacccatgaccctagaacaatgatttctagccactcatactattgttcaacatattaaggttcaatatcatcacaaatagcaaaaacaaagagaagaaagtaagaacttgatgattcaaagccctccttgcctcttgcctctctagttcttgcaaaaccttataaaaaccttgataatttgaccttgggcgagcttgactttatataggttaagtggctttttcctccgaatttccatttttgccctttttcacaatattcccgttgcatggacatgcacgggcgcgcacttggccgtgcattaggccgcgcatgtcactggaattttctgtcaggacgcgcataaatgcgtgggcgcgcacctgggcgcgcatttggccgcgcatgcccaggtgttcattcttcgctttttttcttgtctttctttgaactcattcagtcccgaggggttttgtcttgctcccaaatggttccaatcgacattcttttgcacatactgtcacacctcctttttcactacacccgcatgggcgtaagagagtttttccattttaagtgacaatcagaacaggattatttatttcagagtcgccacttgggaaaggtttggtttttggtgtcccaagtcaccggttttcttgaatcccgaaccgaggaaaatttcgactcccaattggagtctgcgaaccagagatcctgaataaggaattctgttgacccgagggaaggtgttaggcaccctcggatcccgtggttctagcatggtcgcttaaatcattgtattaggttaaaacctgattttaaaacatgctatttgtgctttatatttataaactgcttttatcttcatttattttaaaagacttgcgacgtagtgaaaacgcgtctcgaatcacgacaaaatcaatgagcccgtgattgtcaacacatttcgacttcgtcgagatttggatttgggttacaccagtgcacacccgagtttaagaagataatttaattaaaacgcgtctaaagattctagcgtattattatttggggaaggccatgaaattcactaaatggccctcccaaactctaaggatcaactcaagattaaataaagcgagggccatgcaattgtcacttttgtttggcatggcgcgcctcaacattactctactgtaaatgtcaaacccaaatctaacagagtagtataacaaaattaaccattaagtgggcatgaaaagaccatcagaagcctgacataaagaagatgaatcaatgcctaacatctatgccaaatatgctgaatctctaaattttcaatgattgaagtgttccacataactcctgaaggactaaaatgcagtagcaaaaggaaatagagatgaccagattttcacgacagatgcctacaaagagctaatttaagcagattgatgaagcattgtaggagaacttatttcaaactcgaacttgacggaaccagatcagcatagtcatgagaagcacaaatgagcaggttacagacttaccattcatttaacagtcatgagacagtttaatttcataccatgaattatcagaacccaaacatgtcttcctttcaacagatcctttatccggttaaaccaactaacatctagcttcgcaattctgaaaagtagccgaaactgaagcaaactacccatgaagatcgtaactacgcatcattaatcagacattcactcagcacacatatcaccaatctgatttcacttaaatgtgccgcaactacaaaaaaaatcaacaagattcgcgaagaagttgcatcacagagtagtcacgcctaaactgacttgcaaactgttttcattttaacaaaatcactactaactgaaatgcagactgatgaaaaaacttgcttcagccttttgatattcaacagtgaacctagcctaacagaattagcactcaaagttaacgctcaaaagtgcgaagcaggacaggctttgaatgcagaatgaacactcaaaatcgtgcaaatgtgttgcccaaacaatgcaaaacagggcagatttcagcagggggcaacagtctgtacgaatgtccaaacaaccacaggttcgatcaagcctcagtcattcctaccaaagtcgagcaattccgtcctccatcattgtgttagatgaagaccagatcacacgtgcaacatccaatcaatacgtagttaagaagcaaaactgaaattgaagaatatagctcacattctgaaatcgctcacaagctaatcctaccatgacaggaaacaacaacagaggacaatttcagagaactcattttaagatgtatacagtcaaaccaaatcggaaatatgcgtaaaatggcaaacagatacactacgaccaacaaccaccaagagtcaaatagttccaacccagctgaactcgtattctcgatatatttccgaatcaaacaccaaaaacgggctacaggagataaaaaaaatgaacctgaatcagtaacaacctgaactttgctcgagctttgaatacaataaaagctggaagctaatgagtagaaatcggaagctcagacagtagcagactcaacaaccttcagtcgatcaccattttcaaacgaactccagctcagaaagaaggcacgagatgtatatttttttgatttttgttttttgaaagtaattgaaaacaaaacagaatcagaagacgatgaacactttttttttataccttttttttcttattctcgaactcaaatcccatttccgtatggaagaagaagcaaaactattttaaaactcaatttcttctcccaaaattcttacccgaaaaatccaaacctcctccctcacgaaattggataaaatctattttgaagaccaatccttgatgaatgtggggctcagattgagtgaaatcaatccaacgcctcacactcatccagccttcgtcttccagacccttccaatcacgtgtttaaactcgaattcgagcgagtgggaggaggaggaatcttggcatcagaagccgttagcaacagcaagaggagagatagaaggacgcgtgggttagggcttgatgctcactcgcgtgaatcttggcgatttttgggacgaatttggggcttggttcgcgtgttcttcagagaagaagaacagtcgcgtttgattagggatttggcttcagcgttatttctgtgtttaattggggatcgggtcgggtctctaaacgggacagacgggttttgggcgtgggtcacctggtttgggaggggaaagattgggcctggggtagaggagttaaaatatggcccaagactttgacttctcaattctctcttctttatttcaaaacactttgtcccaaaattctttttcttctttttttcaaaattttaattaacacctaaagtaatccctaagtcaaattatcctatcacaaatactaattaattctatataataatcaacacaaataattaaaaactaaatttaaaggaaactaccaaaatcaacaaccaagattaaagtgtgcaaaatgagatatttttgtaattttcttttataaaataacttaataaaatgcaaaattaactcctaaatgcaaatgcacttatatttttttgtatttttcattaattaaatatgcacaaaaaatgcaacaattaccaaaaataatgccaaaattcacaaaagttgtaaaataataaagaaatcattttgtttggaattttttggaataattcatatatagggcaaaaatcacgtgctcacacatactaggctccttaacctgcaataagtacaattcacaattatagcccatactttatcaattaatcataatatacgatcggaatataatcaagtaaaggcacaaacaatggctaaatcacccagaatttgcctattatcagtgccctcccgtcaagtagaaattcaggaagttcaagacagacatgagtgtgaagattaaagaagaagtaaccaagcagctgcaggcaaaggttattcgggtcactcgtatcctgattggttggctaatgtggtgccagtgccgaagaaagatgagaagatcagggtatgtgtcgattactgcaatctgaatagggcaagtccaaaggataactttccattacccaacatccatatcttgattgataattgtgtcggacgtgatatcgggtcttttatggattgctatgatgggtatcatcagatcctgatggatgaagaagatgcgaaaaagacggctttcattacgccttgggggatttattgctgccgggtaatgccgtttggcttgaagaacgctagggcaacatacatgagagccatgactattgtgttttatgacatgatacacaaagagattgaggtatacatagatgatatgatcgtaaaatccaagcatcaggaagaccacgtagcagacctaagggagttttttcagagacttcgaaggtacgatattaagctcaacccagccaaatgtgcattaggtgttccatctgggaagctattgggattcattgtcagtcggtgatgcattgagttggacccgtcaaagatcaaatccatccaagaattgccaccgccgaagaacaaaacagaagtaatgagtctgtttggaaggttgaattatatcagcaggttcattgctcaactcacggcgacttgtgaactcatttttcggctattgaagaaagatgttgcggtagaatggaccgcagaatgtcaggaagcacttgaccaaatcaaagggtatctatcaaatccacctgtgttggttccacccgagctgggaagaccgttgattctctatctaacagtcctggagaattcatttggttgcatactggggcaacgcgacatcacaggaagaaaggagcaagccatctattatctcagcaagaagtttaccgtctatgaggttcagtacactcaacttgagaagacatgttacgccctaacttgggtggcacagaaattgaagcattatttgtcatcctatactagttatctcatttcacgcttggatccattgaaatatattttccagaagcccatgcccacagggagattggcgaaatggcaaatattactcacagagttcgacatcgtctatgtgatgaggacggccataaaagcccaagcattggctgatcacttggctgagaatcttgttgatgaagcatacgagccattgaggacgtattttcctgatgaagaagtgatgcatatagatgagttggaattatctgaggaaccagggtggaagtttttctttgatggagctgcaaacacgaaaggagttggaatatgagcggtacttatctctgaaataggacatcattatcctgttacagctcagctacgtttttattgtaccaacaacatggctgagtatgaggcatgcattctgggcttacgattagctgcagacatggatgtccaggacgttttggtcttgggagacttggacctcctggtgcatcagattcatagtgaatgggaaacacgggatttaaagcttataccatatcgacaatgtttgcacaatctgagcaagcgatttagagcagtggagttcagacacatcccaagagttcataatgaggttgccgatgctttggccactttagcattgatgttgcaccacccagacaagattcatgttgacccattgcatgttcatgttcatgatcagcatgcttattgcaacatgatagaggaggaatggatggcgagccgtggttttatgatgtcaaggaatacctcaggatggggatatacccggagaaggccaccggagataaaaagaaagccattcggctattgacaaatggattgttcctcagtggaggagtgctgtacaaaaggacagcagatttaggattgctaagatgtatagatgctggtcaagccacgacagtgatgacaaaggtacatgctggagtttgtgggccacatatgagcggatatgtattggcgaagaagattcttcgagcagggtattattggctcactatggagggtgattgtatcagtttcgtgcgaaaatgccatcagtgtcagatacatggagatctgattcattcttcgccgacgtaattgcatataatgtcagcaccatggccattttttacatggggcatggatgtcattgggcccattgagccggcagcttccaacggtcataggttcattctggtaaccatcgactatttcactaaatgggttgaagctaaaactttcaagtcggtaaccaagaagccagtggtggattttgttcattcccatatcatctgtagatttgggatcccaaaggtgatcatcacggacaatggtgctaatcttaatagcagtttgatgaaagaagtatgttaatagttcaagattacacaccgtaattccacactgtatcgtcccaaggtcagtggagtggttgaggcggccaacaagaacataaaaaagatattaaggaagatggtaaaagggtctaggcaatggcatgaaaagttaccatttgcattgttgggttatcgcactactgttcgtacttcagtaggtgcaactccttatttgttggtatacggaactgaagcagtgataccagtagaggttgaaattccgtctctccgaattgtcgttgaggctgggattgacgatgatgaatgggtcaaagcccgattagagcatttgagcttggttgatgaaaagagattggcagcagtttgtcatggccaattgtatcaaaagaggatggcaagagcatataacaagaaggtgtgtcccaggaaatttgaagtgggacagcaagtgctgaaacgattcctgtcacatcaggccgaagcaaagggcaagttcgccccgaactggcaaggaccattcattgtgaccagggtattatccaatggcgctttatgtctgacagatgtcgagggaagatgcatcgacatggctatcaattctaacgcagtcaagagatattatgtgtaatttctttgattgtaattgttatttgtttgtttgtttgtacttggcatttatcggagaatgaaatgacggaggcaatttgttcttctatccaaacactttaacctttgcttccccctttgagccttatttattctttcatacccctctcttggaatcactaatgaaaacgaaaaaaaaagaaggaaagaaaagaagaaaaaataataataaaaacaaaaaggaaagtcacaagaaaaacaaaggaatcgagtgaactacgttcgacctgattcctcaaagaggatacgtaggcgccacacggctcggtcatagtgtagcgaaaatcaaaaaaaaaaacaagcaagaaaactggggcagaagttatgttttaaattttgcaaaaagtttgattccaagagttgtaatgttttacccattaaagttattctgaatttttgatacccttttattttagccccacaaaaacccatattgatgtccaaaaaaaacctcccgatcagtatccgagaggtgccaagtcaggcaaatgaaagccgagaataatacattgatccccgactgaatgaggatcatgagctagaggaattgatagacgaaggaatccctagtaaagagaatcttatcggtaacactccaatccccagctgagaaagaaaaataaaatgagagagtcgtatcggtgaaaaccttcacaggcaccataaggcgacgaaagctgagagaaacaaaatgagagagtcttatggtgagaaccttcacaggcaccgtaaggcgacgagagttaagagagatgagagcgtctcattagtgaaaactcctcgaagggcactacgaggcgacaaggatataaaaagggcaaacaagataagattggcggaaaggatccgcattcgacaaagaattaggtgcctgctcatccccagcaaaatgaggccatcagaaagcttgattggtacaaatagactgggttgattaatccggaatgtacgacatgatcgttgggatcggttatatcatccagataagttctttttcttttcttctccccagcatttgttcagaaagacttcttctttttctatcttttgaagtctccaccagtttattttttaggaggatttttcagagcttactaccagttgccaaaatggtgcaaagcaagatgtgaataggacaggccaaagataaggcaataaaatgaaaaagaagtttgttgcaagaccagatgatgaattggtctagaatttcagggaaagtatggaggaaaacagaaaaacaacagttgagaaatttgtggatcatcgagatgcagaagcatccccgacagattatcgaccaagtcccaagagggttggacaacacagagcggggagggaaaaagggaaaaaccatccccagcaggaatatcatccccaacaaataatatcatccccagcaagttttaatagcgtaatggaacgcagagcagggaaaggaggaaggaaaaaccatccccagcaggagtggcacgaccactcaccacgttttaaactaacaaatatttctttgatttgaagcagggaaaggaaatgttgttgatggcggaaagacatgccacaaggaagatcaccaaaactggggaagaagattttctgccattgttgaaaattttctcagaggaacgaggaaatcaattcaatattataacacaagtcgaggaaagttgaagaagtcaggagccctcctggagaatggaagttgttaaattttaagttgaaaaagtcaggagcccgcctggagaatggaggttgttatattttaagttgaagaagtcaagaacccgcctggagaatggaggttgttaaattgttgatgaagtcaggagcccgcctggataatggaagtcgttaaatcttaagttgttggtgaagtcaggtgcccgcctgaagaatggaggttgttaaattttaagttgttggtaaagtcaggagcccgcctggagaatgaaggttgttaaaatttgagtggttgatgaagtcaggagcccgcctgaagaatggaggctattttatctctaaatttttgttggagtcaggagcccgcctgtagaacagaggaatgcactcaagatcaagtcagaaggcagtaaggcggagggttacaacaaaatacccccagcataaaatacactatagaaatcagaaagcaaggcaacaagagcaagtcagagatagataaaattttgtaattcctagtttagtctagcttcttgttttcttttatcaatggtgtaataaggaagtcagtaagcagtaacagcagcatgcaactgtagtaacagcaaaattacagtcccgtggtagtcccagcttccaaaacttcccgaactacattgacctgattcccttttagccagggatatgtaggaaacatttgaatcagaggttcggtcaaccatttcaaaaaatgcttcacatggagtattcgaagtagcaaaaatcgctcgtatccgctcactttatctttgcacgaaaacccttcgtgttttcggacaaagaggggcagctgtgagcacgtgattttggcttcacaaaaaaactactccaaaaaaaatcaaaaaataaaacaaatttcctttgtgtacaattttgagaatttgcgtggtatttttggctaatcatttgtatatttgcctgtgaatgtttattttatttctattaattaaaaatacaaaaatgtgttgcgtgtgaatttagaattttttttattttacgattaggaattaattaagccatgtttggtttttaaaaaagaattaaaaataacaaaatgtataccttttgcatttttagccttttctgtccaattatgtgattgtgttttaattagtgtttaattttagattttaattattaagagtcaattatattttaattattaagagtcaaatagtattagtgtttgtaaattaggaattaaaaagaggaaaataaaattaaaaaaaagaaggaaaagaagcaaaaaatgaaaaaatgaagaataaaatcataattgggccagtttttaaattaaaagtcaggcccaaataggtgcccaggttggtccaatctcagagacggaccaaacgatgtcgtatggtctcattcaatctgagccattgatctcctcaaatcgaacggttcagtccatctcccccttcagcgaaacgacgtggtttcaaaacattcaatcctgatcgtttgtttaattcaatcgaacggtgacgaatcctcacccgttgcccgatctagaccgttgattttaatcaatctaacggcctagattgaatttcgtctttggtatataatactcaaacggacccatccccccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccacccccccccccccccaagtcaaaccccccttacccttttgtctctaagctcagagaccggatgataacgccgccctcaaccaccgccctcctcccaccggcaatcgcctcatggcggttccggtgggccaaatgcccccatttttacaccagagatcccccttgaccttcccattctgaatccccgctcctttttcttcgaatcccagccgatgttatcgaatcttcgatcgaaggttcagacagaaaccctagtttatctgacgaccaccaaactaacacctcttaacccttggacctctctcaccactagaacctcattggtttccctcgaatcaccctggaacccctcgaataatgaataaaagccaagaaccctaagtgccgccacatgattcccctatggcggcgctgacttgaaccggtccaagcgaatccaaggtgtcgttctgagtcagtggtcatctcaagactactcaatttcgatgtagtgcacttcgtctgttcttcacaaagaacagacaattttcactatttcgaggttaaggcaaatctgttggttggcattcaagtgtaagtgccctgttctcactgtcgtttaaataatcctttcattttctactcctttcttcttctccgaaatgtagataggtctatgtttgaacccagttccttaaatgtactgtaagttaattcatattcatttttgtttgaaatttgatagtcatcgtcaatatactttcagtgttcttacattgtatagaggtttaatttagaattgtattaagtcatgccccgtatctatgtcaattttgttaatctttgatcttagtggttagatataagtgttctaaatcattgaatccttggttttttttttgtcttgagtgctatttaattcgatttgagtttcgagcttaaattgtgacttgagtttgatgaaccctgaatgttgtatgaatctgatcgtcaattagttcggaatatgagtctaactttgatgaactaaaccttgaaggttgttgattaggagttagcttcatttagcttcatagggttaattagttaattgttaggtgaactgtgaatttgttatagctgaggtgttagagttagattcagttcatttagataaaattgaattaggaatcaatgtagtcaatggttataactgggatagggcagtagttcagattcctatgggggtagtttgggatttgaaaacctaaaagtggctaacaaagtggcctgccaattgaatattcagtgaactattaaattaaggactttctttaataaaagaatggtctggaatgagtcaggagaaacatgggcattatcagggcattgtttaatttagagaaaaaaccatactgcccataattagggaatttaataatgaaaagactgaaacgatcaggaatgcttcagggaataacatggttgtaaaaactgaaaagaaaggacattctgaaaaggttgtaaaacatagtgcttgtaaggttgtaaagcgagaagcaagaaggctgaataataaaaagggtatgagggggaatatacagcaggaaaaaggtggaaacatggaataaaatagggaccagttttagtctataaaaggggggagggtactgtttcatgggggaccggtttttgaatcctaaaaagaataagtaagagagtttcgagttctggtcaattttcataatattctgaaatgtttaggagttctttaagcatccaattttgaagctaagactgagagtttaaaaagaagaaagatcagagtttcttccagttttcttcagagagttttaactagcttttgaaatctaaaagagtcagaatttgagagtgataaactaaaaaatctactgttccattggattttggtttgtttgaagtttcagaaattcattctgttcattttcaagcttgttttttgggtaattagttgctgtgttggagtctatacatcaaccctgtttggtttaaaaattctggaactactgggggtgtttggttgctgttggtatctgctgttgcactactgctattgctatttgctatgttatgactgttgctgaccttcctctcttcatcttctgttactttcaattccaggtacactaccttgagtcactttgatgtatgctcattgaagcagaaatgaaatggccagaggatttattgttcaaactatagaatgcttgtattctatttgttattagttatgtgttttctgttaattgaatggtagatatatgtataattaggactgcttttaaatcactgattggcaattaaatgatgtatgatatcggactactgaactgaatccttaaaatggcagtcagttcagtatgtgtgtttaatttgagcaaactgttagattgctaaactattaggtgtgtgtctgtatgaatttcatagttaaatagtttcagctttgttagttcatattattacaataaggtagttcaaaatcacattcaacttgagttgggttatgtagtagatatttaccacatcatataataatatgcaaattagcactcactgtttagtttacataaatcaaaataagtcattagatattgaaccagcttggactacacctaggactgtcttaggtagttttgaaccggtttcctcatacccgtggccatttgaattggtaaatagttaatattgagaatcgtttcgatttagttgattggtaaagtataactttgaactcacgaaaactggaatagtgagctgaagtttatgattttgagtcctgttagtaacaaagatccgcaaatcttggcagaaataaaaataaccagtaaattcgtagaatcagtaggccttgctgtaattgaagtttggttcgatgtagtaaagctaaggtcattaacccaataggcatgagttgagttcgaacaagacatgttaacgttcctttgaatgcaatatatttttcaagtgccgattaattttaacaaactttcgaataagcattagtgattgaggttagttctagtttcaaataattgtaaacaatgaatttcaagtggttctgaatttcatacagttaattccaacggtccaattatctaataatgttggtctaagttagagaaagactaattagtctgttttgataaatattgtttgttaatctcatgttctatttatattcttgactttagtaatattcactaatagaataaggaaggaaataatctccctttgttcaagctcgagtgcaattttctgtttgcatttgtcataatccgataaataagttacggacttttcaagcatgtaattaatttggacttttctttatcattagagacaaaaataagtagaaatgtagtcaatttaggattgcccttttaaaataaacgagatgagccccgccaaataaaaaataaattgcggggccctcagtagatggttatcttaaatgcttagatttcgagataggccgtatagtgaatttcacggctcttctcaaaataataacgctttagcatctttaggcgcgtatttaataatattatctccctaaactcgggtacacatttatgtgacccaaatccaaatctcaacgaagtcggaacatttcaaaaactgcgggtatatttatgtgacgcggtttgagatgcattctcacgacgttgcaattctcttaaaaaataataaatgataaaaatagttcaaggttaaaatgggcacataggttcaaatttattaaaatcagataaataagctatatatgacagttgaacgaccgtgctagaaccacggaactcgggaatgcctaacatattctcctgggttaatagaattccttatccagatttctggttcgcggattaaaccggtgacttgggacaccataaatctcccaagtggcgactctgaatttaataaataaatctcgttgcgattgtcctttaattggaaaaactcctctacgcccctgcgggtgctggtaaaaaggaggtgtgacaatattcactacccgaacttagtccaacctctagaacacccaaaacaacaccaaaacaccaaatcaacctcgaattctagcctaagaaattctaaacttccaactttcgccaactcaagcctaattctaccacagaccttcaaattatattcacgatacactcgtaagtataaaatcacccagtgaagctaatcgaatcataaatatccaaatccgaattcgtttactcataagtcaacttccggttgatatttctaacttagctttataactaagagattaagtgttcattttactccaaaactactccgaacctaaacctaccaactcgataacaatcaacacagctgaacaatacataaataatcatagatggggggaaatggggctataactctcaaaacgataggccgggttgttacactcaggccctcggtctcactcaatcatcaatctctccagtctcactcacgggctcacaacaccatgaaactaacctaataacaagtatatgatgtatcagaaaataataaatgtgactgagatatggtatgaatgcatggatatcactgagtacaaaatatcaatgaaatcagtgagataacagtaaaaaaatgaccactatgggtccaaacagtatcgacatattgcattaacatgatgtgtagcatgattgacagcttaactactttatcatatggtaataacacgaatatcaacaaagtacgaccactatacagtgccatggaagcaacagagtcccaattcacatggtgaacgcccgcacgcccgtgacctagcaagtgtgtcacctcaataccaatcatgtaacacatattacatggttcataccctcagcactaagtttagaagagttacttacctcgaacaagccaatataaatgccgagcaagccaagaaatgtttcagagatgctataacgcacgtggcgacctccaaatgcctcaaaactatccaaaagcaactcaaatacatcaaataaagcctaagaaaaccataccaaatgataaaggtggaagccttaatcaaaacccaaaaccgaaaaaaaaatacacacgggctcgcgcctcggaacccaacaaaactcataaaatccgacaacccattcaataacgagtccagccatactagtttcacataaatccgactccagttcgatgttcaaaactcaaaaatttatattaggaaacttcaggccaatacctttaatttctctttaaagattcatcaaccaattttcaaaaattaagatagattcatgaaatataaccaaaatggagtagagaacacacatctagtgaagagagatttggtgaagtttgctccaaatttttcatatggtgaagtttgctccaaaaattttctcaatatgagtcccacatctgaaaacatgaagaaaagaccatgaccctcgatttatagcttctaccaacattttcgcaattgcgaataagtggccgtatctgcgactttgcttttgtggaaaaagtctcatatttgcgagacatcctcaaccgtccagtggtcttttctgcgatactcaaaaccgcatttgcggtcacgcttctgtgcaaaatcttctgcatttgcggactctcacccaatagtacattcttgcacatgcgcaactgggcctgcttttgcggctgtcgcacctgtgcaataccggtcgcaggtgcggaacaccatcaccagcagctcggcaaaaatccaaaatgcgatgaaatgattcgaatcttgtccgaaacacacacgaggcactcgggaccccgtccgactatattgataggtccaataacataaaatggacctactcgaggcctcgaatcacacataacaacatcaaaacgacaattcgcacctcaaataaaaaatctatgaactttaaactttcaatttccaaaactcgcgccgaaacatatcaaatcatcccagaatgaacccaaattgttcactcaagttccaaatgacataacgaatctattccaattcctgaaaccacaaaccgaatatgatatcctcaaaatcaacttccggtcaaatttatgaactttccaaaccttcaaatttcaaaaattttccaacttgtgccgaaaccttctagaaacatccagatgcagatccgcgcacatacccgggtctaaaattgacatactgacctaccagaaccatcaaaactctattccggggtcaaatttacaaaaagtcaatcttagtcaactcttccaacttaaagcttcaacaatgaaattcattcttccaatctgattctgaataacctgaaaaccaaaatcgacaattcacataagtcataacacatcatacggagctactcatggccataaaatatcgagagaagtgcaaattctcaaaataacttattggatcgttacacatatctgtgaagaaggtagaccagcccatgcaacaccaccaacttggtctcaatttttggaaatattttttaaatagtttgttacccagacactttgagatgcgtggcatacagagtttgaacggttgtgtcagggcactatgatagagttagaatatgctttcaggttcagtgagttaacccgtcatgcacctatcttggttcctacagtcagtgagtgagtgcgcaaattcattgatacttactaggtaccgactatggtgtaatcatactacacctttgcacatttttgtgtagagctaggttttggagatattggactcggacaaagttagagcatgatcgcaaggattaaaagtagagctctttggtcgttgcagtcccttggagtctttccattttttgttgtactattaatttcttattcaaaaaatattatataatcggtcctaattaagaacattccatgtattcaattagagttcgcgactcagtattaccagtcttttgaggttgatatatttgtttccgcttctggtttcgacactcgtattaaattataatattttttaagaaataacatgaattataattataattggcttacccaattttagagaataggttccatcatgacgcctacggtgggattttgggtcctgacattctcggtcttccttatatgatagcatcagcgagcgccaatataatgattcccatttacttgtcctgaaggacacagttcatcacggttatgctaaggatgttgttgttgtagatgatctgatgttgaggatgcatggtcgtatttttgtaccaaatgtggatggactacataggttgattcttgaagaagcccaatgtttgtggtattcaattcatccgggttccactaagatgtacgaagacttgaggcagcattactggtagagaaaaatgaagaaagatatagttggatttgtagctaggtgtttaaattgtcaataggtgaagtacgagcttccgagaccgggcagatttcttagagaatggaaatttcggagtggaaatgggagcatatcaccatagacctcgtaattggactccacggaatttaggaatttctatgttatttgggtaattattgatcggttgaccaagttcgcgcattttgttccagtcaatactacttattttttggagcggttggttgagatttatatccgtaagattgttcgcctacatggggtgcaagtatccatcatttctgatcgaggcacacaatttatatcatagttttggagagcagtggaacgagaattgggtacactggttcagttgagtacaacaattcactctcagacaaatagatagtcccaacgcactattcaaatactgaaatatatgctacgttcttatggtatagattttagggttcttgggatcagtttctgccacttgcaggatttgcttacaataatagttaccaatcgagcattcagctggccctgtataaggctttatatgggagatggtaaccatttccggtgggttggtttgagttaggtgaggctaggatagtgggtactaatttattttaggatgctttggaaaaaggtcaaattgattcaggatcgacttcgcacgacgcagtcaaaatagaagagttatgtcgaccgaaaggtttgcgacgttgcttacatggaaggagagaaggtactactccgagtttgcctatgaagggtgttatgagattagggaagaatggcaagttgagtcctaggtataatgggccttttgaaatgcttaagaagattggagaggtggcttacgaactggctttgccgcctagtttatcgagtgttcatctagtgtttcatatatatatgctccgaaattatgtcggatatccatctcatgttttggattttagtacagttcagttgaatggtaatattacttatgatgtggagctagtggccattttggtcgggcatgttcaaaagttgaggtcaaagaacaaagcttcagtgaaagtacagtggagaggccaatcagccggagatgatacctaggaggttgagcggagatacaaagcaaatgtccacacctatttgaaactctaggtattattctaaacccgttcgaggaagaacatttgtttaaaagggagagaatgtaacgacctggccggtcattttaagtatttcaggatcattcccccatgtgtagtacttccgtaattgatcttttaataggttactggcatagcgtgcttaccgctcgttgtgctttacaattattatatgacttgccggggtaattggttcgagtctggtgagatttcataatgaattgaaatatttagttccaagatgtaaagcttaaattgaaatagttaaccgaatgttgacatatgtgtaaatggactcgtagtcgggttttgatgattccaacagctccttatggtaatttttgacttaggagcgtatccggaaaattatttggaagtctattgttaaagtaggcttgaaatggcgaacataggaagtttaagtttggaagtttgaacggggatttgattttttatattggggtcataatcatgttctgaaaattttcataggtcgttatgacatttatgttttgtgtacaaaatttgaggtcaatatgacttgatttgataggcttctgcatcgaatgtagaagttggaatttcttagtatcattaagcttagattggggtataatccgtgttttagcattttatgatgcgatttgaggctttaactaagtttatatgatgttttaggacttgtttctataattggttgaggtcacaggggcctcaggtggatttcagatggtttataaataggaatttagacttggaagatagctgaagctacagattcgtggtgtctggtttctttcttcgcatttgcgatggaagtcccgcgttcaccaagggtatctggaggcaggtgaagagttgatcttcgcattcgcgaagataagaatgcgttcgtggagggctgggggttagtgtgcatcacgcgagttctccgtgcatcacgtgagttgtccatgcaatgtgtgaaacttctagtttctcagttgagtacaacaattcactctcagacaaatagatagtcctagcgcactattcaaatactgaaatatatgctacattcttatggtatagattttagggttcttgggatcagtttctgccacttgcaggatttgcttacaataatagttaccaatcgagcattcagctggccctgtataaggctttatatgggagatggtgaccgtttccagtgggttggtttgagttaggtgaggctaggatattgggtactaatttgttttaggatgctttggaaaaaggtcaaattgattcaggatcaacttcgcacgacgcagtcaaaatagaagagttatgtcgaccgaaaggtttgcgatgttgcttacatggcaggagagaaggtactactccgagtttgcctatgaagggtgttatgagattagggaggaatggcaagttgagtcctaggtataatgggccttttgaaatgcttaagaagattggagaggtggcttacgaactggctttgccgcctagtttatcgagtgttcatctagtgtttcatatatatatatgctccgaaattatgtcggatatccatctcatgttttggattttagtacagttcagttgaatggtaatattacttatgatgtggagctagtggccattttgatcgggcatgttcaaaagttgaggtcaaagaacaaagcttcattgaaagtacagtggagaggccaatcagccggagatgatacctaggaggttgagcggagatacagagcaaatgtccacacctatttgaaactctaggtattattctaaacccgttcgaggaagaacatttgtttaaaagggagagaatgtaacgacctagccggtcattttaagtatttcaggatcattcccccatatgtagtacttccgtaattgatcttttaataggttactggcatagcgtacttaccgctcgttgtgctttacaattattatatgacttgccggggtaattggttcgagtctggtgagatttcataatgaattggaatatttagttccaagatgtaaagcttaaattgaaatagttaaccgaatgttgacatatgtgtaaacggactcgtagtcgggttttgatgattccaacagctccttatggtaatttttgacttaggagcgtatccggaaaattatttggaagtctgttgttaaagtaggcttgaaatggcgaacataggaagtttaagtttggaagtttgaacggggagttgattttttatattggggtcataatcatgttcttcaaattttcataggtcgttatgacatttatgttttgtgtacaaaatttgaggtcaatatgacttgatttgataggcttcggcatcgaatgtagaagttggaatttcttagtatcattaagcttagattggggtataatccgtcttttagcattttatgatgcgatttgaggcttcggctaagtttatatgatgttttaggacttgtttctataattggttgaggtcacaggggcctcgggtggatttcggatggtttatggataagaatttagacttggaagatagctgaagctacagattcgtggtgtctggtttctttcttcacatttgcgatggaagtcccgcgttcaccaagggtatctggaggcaggtgaagagttgatcttcgcattcgcgaagataagaatgcgttcgtggagggctgggggttagtgtgcatcacgcgagttctccgtgcatcacgtgagttgtccatgcaatgtgtgaaacttatagtttctcagttgagtacaacaattcactctcagacaaatagatagtcctagcacactattcaaatactgaaatatatgctacattcttatggtatagattttagggttcttgggatcagtttctgccacttgcaggatttgcttacaataatagttaccaatcgagcattcaactggctctgtataaggctttatatgggagatggtgaccgtttccggtgggttggtttgagttaggtgaggctaggatattgggtattaatttatttcaggatgctttggaaaaaggtcaaattgattcaggattgacttcgcccgacgcagtcaaaacagaagagttatatcgaccgaaaggtttgcgatgttgcttacatggcaggagagaaggtactactccgagtttgcctatgaagggtgttatgagattagggaagaatggcaagttgagtcctaggtataatgggccttttgaaatgcttaagaagattggagaggtggcttacgaactggctttgccgcctagtttatcgagtgttcatctagtgtttcatatatatatatatatgctccgagattatgtcggatatccatctcatgttttggattttagtacagttctgttgaatggtaatattacttatgatgtggagctagtgtccattttggtcgagcatgttcgaaagttgaggtcaaagaacaaagcttcagtgaaagtacagtggagaggccaatcagccggagatgatacctaggaggttgagcggagatacagagcaaatgtccacacctatttgaaactctaggtattattctaaacccgttcgaggaagaacatttgtttaaaagggagagaatgtaacgacctggccggtcattttaagtatttcaggatcgttcccccatgtgtagtacttccgtaattgatcttttaataggttactggcatagcgtacttaccgctcgttgtgctttacaattattatatgacttgccggggtaattggttcgagtctggtgagatttcagaatgaattggaatatttagttccaagatgtaaagcttaaattgaaatagttaaccgaatgttgacatatgtgtaaacggactcgtagtagggttttgatgatttcaacagctccttatggtaatttttgtcttaggagcgtatccggaaaattatttggaagtctgttgttaaagtaggcttgaaatggcgaacataggaagtttaagtttggaagtttgaacggggagttgattttttatattggagtcataatcatgttctgaaaattttcataggtcgttatgacatttatgttttctgtacaaaatttgaggtcaatatgactgatttgataggcttcggcatcgaatgtagaagttggaatttcttagtatcattaagcttagattggggtataatctgtgttttagcgttttatgatgcgatttgaggcttcggctaagtttatatgatgttttaggacttgtttctataattggttgaggtcacaggggcctcgggtggatttcgtatgatttatggataggaatttagacttggaagatagctgaagctacagattcgtggtgtctggtttctttcttcgcatttgcgatggaagtcccgcgttcaccaagggtatctggaggcaggtgaagagttgatcttcgcattcgcgaagataagaatgcgttcgtggagggctgggggttagtgtgcatcacgcgagttctccgtgcatcacgtgagttgtccatgcaatgtgtgaaacttctagtttctcagtcattttctgatttactgattttctttctcccttcatgacataatattgtggaccaggatatagttgtactgaattaaccggtgaattcaacaaattaagcttctcttaccttttcatgtttatttgtgatacttaatgagttggttgtactcgcactacaccatgcaccttatgtgttgatccaggtactttcggatacggcgcctgctagattcggggattcatctgttagagattatcgaggtagctgcttggcgtccgcagaccttgactatctcccttttcagttattgtgttgttctatattttcagacagtatttcttttatttgtcatactatgtcctgatttagatgctcatgtgctcagtgacacgggttttgggagtgtatttgtatcaataattatgggattttctgttaaatatacatattatattttcaaacttaaaataaatcatggtttattgaggttgccagcttgcctagtattgagataggcaccatcacgacatgtggatttttggtcgtgacactttcacaaaatctttgggaagaaaattaatatcagaaacatcgaggggaatgagactattgccaatttgagttatatcaacgatgatggtaacccgacctatatgattggagatcccgcgaagtaggttcatatgtgtaataacaagtcattagttgattaactatggactattaaattatgtcacttcctatggtgtgtgtatatagtgcgagacagcaaggaatggaatggttattaaactctaaatctaataatccatagtcttttataggtggtgtataacgatgtagattacccttgatggatgtacctatatgagtgtggagtgggaccgctcctatgaaatttatggcaaaaaacttctagagaacccataaaaaacaggcgcacacgtggcctattagcgcaaaactgcaacaatcgacaaagtgtgtgcaagaatagtgtgatagataaaatactaaacttccaaaagaattcttggttcatagaaatcctaaacatcaccaattgttctgtaagtttaatctaatcttagtttatctaggtctggttcacagtacaagtgacacccgatttgacgcattatgctcatttatgaaaacccagcaaatttttttatttcactatatttttaatattctttttgagatatgtgcgggacacatagaaaaattattttaatatctcaaaaagaattattctaaaattatgtctagattctttttcttaatattatattaatgagtatttattatagcaacaaaaaattaatttatttttgaattcgattgggacacaatcaatcagacaattgaatacttattagtatggatttatacgttaggattgaaaagtcaatgggttaagatttaacgtattcaggaattttctttatggattgaacgtttctatggcaacttctttgaatggtctgtaatatggaaccagacagcctacttctcttttagaatatatgtacctctttgtcttcatgttggaatatagtgaacagagttaaaaacttttcttaccttttctgttgtgcgaggtttttttctcattaatctttgttgtttctgttcctagttatagtagaagagcttgttgaatcctggggatacgcctaataataatcatcacagtgtgtgaattatccttaaggacagtgttcttgacacgcctcaagctaaatcttattcccctaagaaattaacagtacctttctattcagtcaaagttgagtactcaaatcatactataaatagagccgaagaatgcatcaatttctccatccttcaatttcaattccaaaagatgggttccaaggcatttctgtttcttggcctttgtttggccatttttgtaatgataagctctgaagttttagctagggagttggctgaaacttccaccatttcagaagaggactgtaagaaccctctcattatttgcatatatgttctgttctctacttaattcaatgttgtcctatttttatctagtgaaattatttaacctttccaattagagtttaacgtgtcataaagatactatttaaatcccattaaaacaagtaggtactaagttgtataattactatgataataataacacgatacattaattacaattgaattagtggatctgtaaactttactactgttagcttgaccaagacagaggcgggtcttcaagaagatgtgtgtactattataaagaaatgtatttaaaatttacatttgatgtgcttaactttaggtacacttttgaaattataagttcaaaattatattctttttaaaattttagatatattcacgtatatatctatactccattttaaaaataagtccgtccgaagtgggatttgaaccgtcaatttcatgtagaggtgtaattattacaccagaagagtctttgagcatgtgtccacgcacatataattaagtacttttcaagaaatatgatattgttatactccctctgtttcatattgtttgaggtactttcctttttagtctgttccaaaataaatgacacatttctaaatttggaaataattcaactttaaactcttcattttaccctttttgcccttagtgagaagcttttatagccacacaaatggtatgaccccacaaaccttttaccccttaatcttttaagaccacaaattttaaaagtcttcttcttttttcttaaaccccgtgccgagtcaaacaatatgaaacggagggagtatatgatttgatgagaggagtatgggttcacgtgaacccatatcatatgacctatatacgcccatggaccaagactattagggctcgctttgtatgagggataagggatatttaatcctgagattaaatttgagataagttttcagcgtttggttgggataatataacggtatagctgatcccacaattagttatcccaggattgttacattatttttatctctgtgggagggtggaataataaatcacgggataattaatcctgggaaaacatattttaaaccttctaaaatataatcataaatcttactactttatggattacatattttcttcgtaattctgtgtaaggatcacatacaataagctaaaaaaaggaagaataataaagcagttaaagaacaacattcttattttcacaattgatgcagcaaagaaatccagtaacaagaatgaagtacataaagctcaaaacgactatggaggataccctgtccccggataccccgctgaccctggcggcggcggaggaatttccgctagtggtggcggatatcctaatggcggccgtggtggtggtggacactctcgtggcggccgtggtggtggtggacactcccgtggcggccgtggtggtggtggacgcggtggtggtgaaggatactgccgctatggttgctgcggccgccggaattacaatagttgcagcaggtgctgctcctacaaaggtgaggccatccatggataattaggtcaccatattgaagctaagcctcacaacttatcatcatgtggagcaatatataaaacctttgtgctttgtaaagcctcaagatgtaatagtaataatcttgcagctttttagggcgtgttgtaataagttatgaataaaattatcatttaatatttgtgttaattatacaatggtgtgataacgttttcccttttgagcatgttctctttttttacctataggagatttacatttagaagaattaacccaaataatcgtccaccccaccacgtaaattaaaaatagtcggtgaatgtataatatatacataatttatgtatcacacgtatacaattgtgtataattaatttataatctatgcatatggttagaaaaagtaaacaattaatatgatcggttatttatgtaaagatttacttttatacataagagacctgtataaatagcacgaattaatccaagagtgcataaaaaaacacactgtccataacaagagatgtggtgttcgagtctaggtatatggagtcgcatttgttaggaagcgctttaattatcccttaataagagattagtcgtcacgaattcaaatttagctggatcacaatacggatattgaaaccgagtgagaaaagaaacacaaattaattaatttcgatttccttcataacccaagctttcaaaattgaaaaggcaagaaaataacagaacccacgacacatacttaagaaaggaggtctgaatcccgattatgtgacctcgaagggaggtctaaatcccgaatttgcaaaaccctccaattcttcctaaatccctagttttctactatggaagaacaaagattagggctagaaattaatgggtgatgttagaaatggaagaaaatgagttcaagtatataaacctatgaattggtgttgagttttctcctcaaaattgcctctaggccaagctctaacggagagtttatgaaaaattgaagaaatcccctttttggactgttttaaatcaccggcaccagaccttctgacgcgatcgcgaagcatagcatctcattggcctacgcgttcgcgaatttctcttcatgttggtgaatgcttgctcccacccgcccctgcgttctcgatcctagtgtcttgttcgcgaagtgtaacggttagcttcctctcccaagcccatgcccctacgcgttcgcgagaagctggttgcgttcttgaagagtaaaacccctaacacttcgtgtgcgcaacccaactatcgtgtttgcgatgaagaaaatccccctgtcccaaactccccttcgcgatcgcgagaaaggcttagcgattgtgaggcacatgacaccagatacaacagaaactcaagaaaccagatattttctaagttcaaatgatctgtaggctatccaaaacacaccggatcgttcggggttccaaatcatgcatacaaacgagtccaaaaacctcatatgaactcgctcgcatattcaaataccaaaataacacctagaactatgaatcggacaccaaatcaaatgtaatttttaatgaaacttaagaatttctacttcaacaaccggacatccgaatagcgtcaaatcaaattcgttttgcaccacatttgtcatatatgtcatatatatcgaaatggacttataccaagttccgaaactaaaattcggacccgatatcaacatagtcgtacatcggtcaaatttatttgttctttaaacctttaaacattaaattttcaacaaattacgataactcaagctagggacctcttaattcgattctgggcatgtggccggtctcaaatcatgatgcggacccaccgggacagtcaaaatatggatctgggtctgttttctcaaaacgttgatcgaagtcaactcaaatagttttttaaggcacgaattcacattttaattaatttttcacgtaaacgcttttcggaaaaagacacggactacgcatgcaaatcaaggaaggctaagagaagctatttcaggttccgaaacaaataattaaggcttaaaactttagatgaccagtagggtcatcacacaaaatcaaatttgtgagatgaactcataccctcattttttgaaatatttaaagtcttcccagatatccttaatcacgattgcggaaaaacctttgcaatggcgaagtacattccactgtcccagaatttcctctacgcgatcgcatacacactcacacgaacgtgaagcaccggcttcccaggcctacgcgatcaccgatagacccacgtgttggcatagattaatgcccatggccagctcttgcctcctttcctctttgcgagtgatgcttagcccacacgttcgcaatgcacagattccctgccctacacgatcgcataccagaactagcgaccgcattgaacaaaataccacagcttctccaattagcctatgcgatcgcggaccttcccactcgatggcgtttaaggaaaccagatcagtgcaccagaaaatttcagtaattctccaagtccaaaaattgatctgttagtcatacgaaactcactcgaggcctcggggacctcaaccaaatatactaacaagtcctaaaactgatacgaacttagtcgagctttcaaatcacatcaaacagtcctaaaactatgaatcgtgcatcgattcaagagtaatgaacttttgaacttctaacctctacattcgatactgaaacctatcaaatcatggattgacctcaaattttgtacacaagtcaaaaatggcacaacagacctactccaactatcagaaccaaaatccgagcatggtaacaacaaagtcaactctcgggcaaacttctaaattttcaactttcgccatttcaaccctaattcaattacaggcctccaaattactatctggacacgctcctaagtccaaaatcatctaatggagctaagggagatgataattacatgtaaactaaaacaagaaatacatgattaagtctcaaataataaaaacaaacctaacatgaccaaccatatcgataagaaatgaatggagatttattatacctttattcttacttccaacaaaaaaagctatgtattttgccatactagaacacacacaaatcaccatacatcttcatattcctaatatgtaggtaactaattgtgagtcttagcttcagttacttatccaagttttcatttcatcctctaaatccagtttcatgtccatgaaggtgtcagatgccacaatttcttttaatgaacatctcgtaataactaatatagatctagattgttcaatatgtttgttcggtttattctttagtttgacaatttaataggcatttgtattgacaaatatgaaacttacatctctttttcatactttacttgtggaatttcattgagtatgttattattgtaagaaaattacatctcagacatcaagaataaaatgtaattaaaattttaaagaaggaatcatgtctttattgttaacaatacaagagtaatcttattaaaaaaaacaatacaggtaaaatcatatgatgacccgataggtcatttatagttttatcatttatttctatattgtgagacctcgaatagctccgtttaaccttccttattttgtgcgtagtccgtatccttttttcagaatgttttatgagaaaattgataaaaatgtgaaaccatgccttaaaacttatttgagttgactacggtcaatgttttgtataaacagactcgaatcagtattttgacggtcccgctgggtccgtatcgtaatttgagacttgggtgtattcccataatcaaattcgaaagtcactagcttggtttaacgtaatttattaaaaactggtagtttaaaggtttaaagaatttctaagtttgaccataggttgactttgttgctaccagattcggattttagtttcggaacttcatttaggttcatttcggtatttatgacttgtctgcaaaatttggagcaaaatagagttgatttaacgtgattcagacgtccggttgtaaaattaaaagttcttaagtttatttgaaaatttaatttgttttggtgtctgattcgtggttctagatattattttaatttttagattgcacaagcaagttcgtatgatgttattatgcttgtgtgcatgtttggtttggaggctgaggggctcgggtgagtttcagataggctacggaccatttaaatataggaaacattgttggtcttggcttctgatgtcatctggtgtgttctacttcgcgatcacgaatatactcccccgatcgtgaagataatttgagctggggaggatttttctcatcccgaatgtgaggatttggtcacaaacgcgtagtaaggggggagtctaccctttgcgaacgcaaccactccatcacgaacgctaagtgataggaggcggaggagggaatggaactcttactctacgcgaactcgagcctaggatcgtgaaagcgaaggtgaagtgggctaagcctacgcaaaagcgtagagtttgtcgttatcgcgtaagctaattggcgatgcccttctcgaatgcatttggtgtctgattcgtggttctagatattattttaatttttagattgcacaagcaagttcgtatgatgttattatgcttgtgtgcatgtttggtttggaggctgaggggctcgggtgagtttcagataggctacagaccatttaaatataggaaacattgttggtcttggcttctgatgtcatctggtgtgttctacttcgcgatcgcgaatatactcccccgatcgtgaagaataatttgagctggggaggatttttctcatcccgaatgtgaggatttggtcacaaacgcgtagtagtgggggggggggggggtctaccctttgcgaacgcaaccactccatcacgaacgctaagtgatatgaggcggaggagggaatggaactcttactctacgtgaactcgagcctaggatcgtgaaagcgaaggtgaagtgggctaagcctacgcaaaagcgtagagtttgtcgttatcgcgtaagctaactggcgatgcccttctcgaacgcatttagtgtctgattcgtggttctagatattattttaatttttagattgcacaagcaagttcgtatgatgttattatgcttgtgtgcatgtttggtttggagactgaggggctcgggtgagtttcagataggctacggaccatttaaatataggaaacattgttggtcttggcttctgatgtcatctggtgtgttctacttcgcgatcgcgaatatactcccccgatcgtgaagaataatttgagctggggaggatttttctcatcccgaatgcgaggatttggtcacaaacgcatagtagtggggggtctgccctttgcgaacgcaaccactctatcacgaacgctaagtgataggatgcgggggagggaatggaactcttactctacgcgaactcgagcctaggatcgtgaaagcgaaggtgaagtgggctaagcctacgcaaaagcgtagagtttgtcgttatcgcgtaagctaactggcgatgcccttctcgaacgcattaggtgtctcacaaaagtgatgaacacgtggaacctagtcatttaaacttcgcaaatcgggatttcacgtatttttcaccatcttctcattagagcacggcctagaagcgattttgatgagaaatttcatcatcatttcataggttagtgtaatttaactcgttttcttccatttccatcaacatccattgatttctaaccataatctatgttcttttagggtggaaaattaggaatttgaaaagaattagttttttttttaaattgagatttagatctcaagttgaggccggatttcaaaattaaacaaataatcaggctcgagggtgaatgggtaattgaattttggtccaaatcttgggtattgaccaagcgggccaggggttgacatttgttgacttatttggaaaaagtataaatatcttaactttatgtattataatttattttcctaccattgttttatgttgttgagcttcgttagattcaattagtttggaggtggattttagaccgctgtcataaggtgctgcggaacatgggtatagctgagaccaatgaggatcgattttgcattgttttagatgactgattctagaaagaggtggttgagagattatttgttaactagaccagggggtcgcctacacttacttggggataagttttcatagctatttctagagatgttcattctgacactctaagagaggattattccaggtagtttgagcgtcttcaatagggtagtatgattgtcacctagtacgaggctcgttttgtgtacatagctcgccatgccattatctttcttcccactaagagggatagagtgaggagattcattgattggctcacttacactatcaggctacagatagccaaggagaccgagagtgatatttctttctagatggctatagatatagctagatggatcgagatggttcgtgctcaggagaggggcaagatgtctgataagaggcctcaccattttgatggattcagtggttcctcatctggaggcaggagcacttttggtctaggtcatcctctcaggccatttcagtcaatgcttaatgcatctcatagtgcttcagggagtcgttgtccttatgtgcctcattatgagtagccagcctacagtgcaccatcagattgtatcagtgcgcctacgattcatatctatcactatggttatccagctcattcgggtcaacttcagctacaacagccataacaacatgatgggtgttttgagtatggaggtacgggtcgcatcaggaggttctgtccaatattattgggcaacatgccacaaaaacgttcttgttccatggttccggcaccggttgctctattgcccgctcatcttgctaagagcaagggtcaggctgccagaggtggaggtcaagtcgttataggtatagcttagtcatttagtggtggaggtcgggccgttagaggtttaggccagccacctatattccatcctagacaagtagttcagagtggtgggggccagcctcgattttatgctttcccaactaggcttgaggccgagtcatttgacgtcgttatcacatgtactgttccagtttttcatagagatgcttcagttctatttgatccgggctctactaattcctatgcgtcatcctacttttcttcttatttggttgagcctcgtgattctttgagttctcctatgtatgtgtccgcgcttgtgggagatttatttttgtagatcgtgttcatcgctcgtttgtgattactattgggagtcttgagactagggtagatctcctacttcttgatatggtagattttgatattatcttaggtatggattggatgtcatcttatcatgcgatattggactatcatgccaagataatgaccttatccatatcggggtttccttgattagagtggagggggaatcatgtttatacattaccagaagggttatctcttatgtaaaggctcaacgtatggttgcgaatgggcttctagcttatttggattatattcgcgattctagtgcaaaggttacttccatggattcagtaccagttgttcgtgagtttccagaggtgattcctacaaatctgtcggggaatccacccgacagggatattgacttctgtattaatttgattctggtcactcagcccatttctattccaccatatcgtatggcccagccatagatgaaagaattgaaggagaaattgaaagatttacttgatacgggcttcattagactcagtgtcttgccctggggtgtgcccgtgttgtttgtaaagaagaaagataggtcgatgaagatatgtatagactttcggcatttaaacaaagtcactatcaagaacaagtatctgttgccaaggattgatggcttatttgatcagctccagggttcctaggttattttgaagattgatttgaggtctggctactatcagctgatgattagggcatctgatttctctaagacgacttttcgaactcggtatgggcattatgagctcctagtgatattatttgggttgaaaaatgccccagcaacatttatggatttgatgaacggggcatttaagccctatttggattcttttttgattgtattcattgatgatatcttgatctactaccgcagtcgagaggagcatgagcaacatcatcatattgtacttcaaactttgagggatagtcagttatatgccaagcttctgaagtgtgagattatgttagactcagtcgcctttttggggcatgttttatcggtagagggcataaagatagatcctaagaagattgatgtagtttagaactggcctagacctgctatagagatccggaatttcctgggtttggcgggttattatatccttttcgtggagggattttcatccataacatctcattgactcgattgacccagaagggtgacccatttagaaggtcagatgagtatgagttgatctttcagaagctcaagaccgctttgactacaacgccagtattggtgtagcccaccggtttaggattctacacggtgtattatgatgcatctcatattaggctcggtgcaatattgatgcagtatgatagggtgattgcataagagtcatagtagttgaaggttcacgagaagaattaccctgtttgtgacttagagttggcagacattgtgcttgtgctgaagatttggagacactatctttatggcatgtcgtgtgaagtattcacggatcatcagagtctacagtatttgttcaagtagaaggatcttaacttgaggtagaagaggtggttggagctgttgaaagactatgatattaccattttgtatcatctcgggaaggccaatgtggtggacgatgccttgagtagaaaggctgtgagtatgggtagcccgcgtatattccagttagtgagaggccccttgcatcatatgttcaggctttggccaatcagcttgtgagattagatgttttgttgcctagtcatgttctagattgcacagtcgctgggtcttccttgtatgagcgtatcagagaatgtcagtatgattatccccatttgcttgttcttaaggacacggtgtaaaatagtccaattatttattttcacaatttaaaaataacaggaataaacaggtaagttccataactcagtaagtaccacaaagaaatttaacggataaatgcagcaacagcaaaagtaaatgcaacttcacaacaatgccactccatcactcagcactcgcactcagccctcaatacctgaacccgcacggtcaactcacatgctacgcggacaactcacgcactatgatattaatatcctcacaacaggccctcagcctcactcaatcatgtacctcactagcctcaccatcatcaacaaataaggggacacagcccacatcatgtattacaacatattagcaaataatagagattgaggtaatcatgtacaataattcctatgactgagtacaaataatgtgagcatgaataaagcctaagcatgatctgtaacatgaaggtagacaagttcaacaacaagtaactacgtaaacacagatgatggccatgaggcctcacgagatggaccaagtctccatccctcgaggtatacacccacacgcccgtcacctagcgtgggtatcagctccaaacagtcacacaatatcaaatgctttgggtttataccctcaaagccagagttaaaactgttacttacctcaaccgcataaaatcctactccggaatgccctcgtctctgcactcagtctccaaaagctctgaatctaaccataatcagattaataccatcaccacgtgctaaagaatcgaattccacaataaaaactacaaaatatgcaaaaaatccgaaatctaccaaaacccaacacccgagcccacctctcggaatcagtcaaaaatagcagaatcataaacctcgtcctctcccgagtctaaccatataaaatttatcaaaatcggactctgtttggtccctcaaatgctcactataaactctccaaagctcaagccctaactccctcaatttcactttgaaattatcaatctaataacaaaaacgaagatggattcatgaaatataaccaaaatccgattaaaaaacacttaccccaatccatatggtgaacatatcctctaaaatcgcccaaatccgagctccccaactcaaaatatgaccgaatgaacaaacactagttttatatatttttctgccagctattctacctcgcttctcatatcaaacgatcctgaaactcgtatttatgcctacaatggattccttgtgaaattctagtcaagctaggcttttgaatcactcaatttgaccttataatgaatgagatatataggttttaatatttgcattagtgcagatttttaaaaacgctactagtggcaatttcgtaattaatcagtaaaatctggcaacctaattcttagtaaaatgtctctaaaatcctcatacaatgtccaaattcgacgattctttttgctacgggtccgtaattaccaaacgatctaacagtttaatcaaaaaaagaaatcggacctcatttgttgaatatgatagcatttatgcttggagaaacgacgtcaaaacataagaaaaacgagtacaacacaacccaaacctatccaaaactcacccgaggtcctcgggaccttaactaataattttaacaaatcatatatcactacccgaacttagtcgaacctccagaacacccaaaacaacaccaaaacaccaaatcaaccacgaattctagcctaagaatttctaaacttccaactttcgccaattcaagcctaattctatcacggaccttcaaattatattccggacacactcctaagtgtaaaatcacccagcgaagctaatcgaatcataaaaatccaaatccgaattcgtttaatcataagtcaacttccgattgacttttctaacttagctttctaactaagagattaagtgttcatttcactccaaaactactccgaacccaaacctaccaactcggtacaactcaacacgactgaacaatacataaagaagcatatatgggggaagtggggctataactctcaaaacgacaggcccggtcgttacatcctccccctcttaagcaaacgttcatcctcgaacgagtctaaaaacatatctagagtctcaaataggtgaaaccttcagcaataccttctcctcacattcaaataatatgaactcatctcgcggtcatatcatgctcatcacgtatccatccatccactattgtcactaatagggacactaccgaacatataagtctacaagcacgcgctcacacaatcaatgccttagtgctaaatctacaggcaatacccggtcttaaatcctccagactggcccaacatcaatacacagaaatcacatttcgcaccttattcagagaatcacaatccgtcgatgcacaactgataccgagcgctcatgtgcgcatacgaatgcgtggaaggaattcaaagagatacatttcaagctaaatcaatatcgcacgataagaattcaagaaggtgaagttttcctaaaggttctacagcctttcgaagacaagtacaaacgtcttcgtaccgatccgcaagaccttacgaaacccgctcctgactcgttagacctatgtaacctaggctctgagaccaacttgtcatgaccaaaaataaaacaatggtcgtgatggcgcctatcgtgttacaaggcaagcctactttcaaaaatattactactaaaacgattataagaaattagtaaaacatttcaacatttaaattttccataaactaaatcaactctaaatataatatagaaaaatatggaaacgagccccaaacatccgggtgtcactaagtcatgagcgtctaaaactataaattaagatacgtaaactatctaactgtccaaaagaagaaataacaaaaggagtaacaaggccctgcggacgctagcagctaccttgcagtctctaaagatagtcggcctgaactcaacattcgccgcgctctaactcacttggatctccacataaagtgcatggtgtagtatttgtacaaccacctcagtagtaacagaataaactaaggaactgagcagtagtgacgagctaagtaaaacagtccaattatttattttcacaatttaaaaataataggaataaacaggtaaattccataactcagtaaataccacaaagaaatttaacggataaatgcagcaacggcaaaagtaaatgcaacttcacaacaatgtcacttcatcactcatcactcgcactcagcactcaacactcgacactcaatatactcaacactttgcactcactaggggtgtgtacagactttggaggggctcccaaagcccaagcgctaagcacggacaactcacgtgctactatatcaatacctggatccgcacggtcaactaacgtgctaagcggacaactcacgcagtatggtatcaatacctggacccgcacggtcaactcacgtgatacgtggacaactcacacgctatgatattaatatcctcacaaacaggccctcggcctcactcaatccagtacctcactagcctcacaatgatcaacaaataacgggacacaacccacatcaagtattagcatattagcaaataatagagactgaggtaaacatgtacactaattcctatgactgagtacaaataatgtgagcatcaataaagcctaagcatgatctctaacatgaaggtagacaagttaaataacatgtaactacataaacacaggtgatggccatgaggcctcatgagacggactaagtcaccatccctcgaggtatacacccacacgcccgtcatctagagtgggtatcacctccaaacagtcacacgatatcaaattctccgggtttataccctcaaagacagagttaaaactgttacttacctcaaccgcataaatcctactccgggatgccctcgtctctagactcggtctcaaaaagctctgaatctaaccataatcagattaatatcatcaccatgttctaaagaatcgaattccacaatgaaaacaacaaaatgtgccaaaaatccgaaatcggcaaaaacccgacccccgggcccacgtctcgaaatcagtcaaaaatggcagaatcataaacctcgtcctctcccgagtctaaccatataaaatttatcaaaatcggactctgtttggtccctcaagttgtcacttaaaactctccaaagctcaagccctaactccctcaatttcactttgaaattatcaatcatatcccaaaaacgaagatggattcatgaaatattacaaaatccgagtaaataacacttaccccaatccatatggtgaaaatctcctccaaaatcgcccgaattcgagctccccaactcagaatatgatcgaatgaacaaaccttagttttatatatttttctgccagctattccgcctcacttctcatgtaaaatgaccctaaaatccgcatacgatgtccaaattcgacgattcttttttgctacgcgcccgtaattacgatacgatctaactctccaatcaaaaaaagaaatcggagctcaattgttcaatatgctatcatttatgcttgaataattggcatcgaaacataagaaaaacgagcgcaacacaacccaaacctatccaaaactcacccgaggtcctcgggacctcaaccactaattttaacaaatcatatataactacccgaacttagtcgaacctccagaacacccaaaacaacaccaaaccaccaaatcaaccacgaattctagcataagaatttctaaacttccaactttcgccaattcaagcctaattctaccacagaccttcaaattatattccggacacactcctaagtctaaaatcacccagcgaagctaatcgaatcataaaaatccaaatccgaattcgtttactcataagtcaacttccggttgacttttctaacttatctttctaactaagagattaagtgttcatttcactccaatactactctgaacccaaaactacaaactcgatacaactcaaaacagatgaacaatacataaaaaagcatatatgggggtaatggggctataactctcaaaacgacaagtcgggtcattacatcctccccctcttaaacaaacgttcgtcctcgagcgagtctaaaaacatacctggagtctcaaataggtgaaaccttcagcaataccttctcgtcacattcaaatcatatgaactcatctcgcggtcatatcatactcatcacgtatccatccagtcactattttcactaatagggacactaccgaacatataagtctacaagcacgcgctcgcacaatcaacaccttagtgctcaatctacaggcaaaacccgatctcaaatcctccagaatggcccaacatcaatacacagaaatcacatctcgtaccttattcagggaatcacaatccgttgatgcacaactgataccgagggctcatgtgcgcatacgaatgcgtggaaggaactcaaagggttacacttcaagttaaatcaatatcgcgcgataagaattcaagaaggtgaagttttcctaatggttctacggccactcgaagacaagtacagacgtctcttgtaccgatccgcaagaccctacgaaacccgctcatgactcgtgagacctatgtaacctacgctctaatactaacttgtcatgacccaaaatcaaaccatggtcgtgatggtgcctatcgtgttaaaaggcaagcctacttcccaaaatattactactaaaccgattataagaaattaataaaatatttcaacatttaaattgtccataaactaaatcaactctaaatataatatagaaaaatatgaaaacgagccccaaacattgtggtgtcactaagtcatgagcgtctaaaattataaactaagatatataaactgtctaactgtccaaaagaagaaataacaaaaggagtaacaaggcactgcggacgctagctgctaccttgcagtctccaaagatagtcgtcctgaactcaacgatcgccgcgctctaactcacctggatctcaacataaagtgcagggtgtagtatcagtacaaccacctcagtagtaacacaaataactaaggaaatgagtagtagtgacgagctaagtaaaacaatccaattatttattttcacaatttataaataacaggaatacacaggtaaattcaataactcagttaataccacaaagaaatttaatggataaatgcagcaacagaaaaagtaaatgcaacttcacaacaatgtcactccatcactcagcactcgcactcagcactcaacactgaacactcaacactcaacactcaatacactaaacactttgcgctcactggggtgtgtacagactccggaggggctcccaaagcccaaacgttaagcacggacaactcacgtgctactatatcaatacctggatccgcactgtcaactcatgtgcaacgcaaacaactcacgcgttgtggtatcaatacctcgacccgcacggtcaactcacgtgctacgaggacaactcatgtgctatgatattaatatcctcacaaccaggcccacggcctcactcaatcatgcacctcactagcctcaccatcattaacaaataaggggacacaacccacatcaagtatcacaacatattagcaaataataaagactaaggtaaacatgttcaataattcctatgactgagtacaattaatgtgagcacgaataaatcctaagcatgatctctaacattgaggtagaaaagttcaacaacaagtaactacgtaaacacagatgatgtccatggggcctcacgagacagaccaagtctccatccttcgaggtatacacccacatgctcgtcacctagcgtgggtatcacctccaaacagtcacatgatatcaaattctccgggtttataccctcaaagccacagttaaaactgttacttacctcaaccgtataaaatcctactctgggatgccctcgtctctgtactcggtctccaaaatctctaaatctaaccataataacattaatagcatcaccatgtatgaaagaatcgaattccacaatataaactacaaaatatgccaaaaatccgaaatcggccaaaacccggcccccgagtccatgtctcggaatcagtcaaaacttgcagaattataaacctcgtcctctcccgagtctaaccatataaaatttatcaaaatcgaactctgtttggtccgtcaaatcctcacttaaaactctccaaagctcaagccctaactcccttcatttcaatttgaaatataaccaaatcagagtaaagaacacataccctagtccatatggttaaaatttcctccaaaatcgcccaaatccgagctccccaactcaaaatacgaccgtatgaacaaatcctagttttatatatttttctgccagctattctgccgcgtttctcatgtcataaggtcctgaaactcatattttatgcctccaatggattccttataaaattctattcaagttaggcttttgaatcactcaatttgaccttataatgaatgcgatatgtaggtattaatatttgcaaatagtgcagatttttaaatacgctgctagtggcaatttcgtaattaatctgaaaatatctagcaacctaaatcttagtaaaatgaccctaaaatccacatacgatgtccaaatttgatgattttttttgccacgggtctgtaattacgataggatctaacgcttaaatcaaaaaaagaaataggagctcatttgttcaacatgatatcatttatgcttgagaaacgacatcaaaacataagaaaaacgagcacagcacaacccaaacctatccaaaactcacccgaggtcctcgggacctcaacctataattttaacaagtcatatatcactacccaaacatagtcgaacctccagaacacccaaaacagcaccagaacaccaaatcaacctcgaattctagcctaagaatttctaaacttccaactttcgccaattcaagcctaattctaccacggaccttcaaattatatttaggacacactcctaagtctaaaatcagccagcaaagctaatcaaatcataaaaatccaattccgaattcgtttactcataagtcaacttccggttgacttttctaagttagctttcaaactaagagattaagtattcatttcactccaaaactactctgaacccaaacctaccaactcgatactactcaacacagctgaacaatacataaagaagcataaatgggggaaatggggctataattctctaaacaacagaccgggtcgttacactcaggccctctgcctcacttaatcatcaatctctccagtctcactcaagggctcacaacaccatgaaactaacccgataacaagtatatgatgtatcataaaataataaatgtgactgagatatgatatgaatgcatagatatcactaagtacaaaatatcaatgaaattagtgagatgacagtaaaaacaatgaccactatgggtccaaacagtattgacatattgccttaacaagatgtctagcatgattgacagcttaactactttatcatatggtaaaaacacaaatatcaacaaagtacgaccattatacagtgccattgaagcaacagagtcccaattcacatggtgcacgctcgcacgcccgtgacctagcaagtgtgttacctcaataccaatcacgtaacacgcattacatggtttcataccctcagcactaattttagaagagttacttacctcgaacaagccaatataaatgccgagcaagccaagcaatgcttcagagatgctatcacgcacgtggcgacctccaaatggctaaaaactatccaaaagcaactcaaatacatcaaataaatcccaaggaaacaattccaaatgataaagatggaagccttaatcaaaaccagaaaccggtaaaaaatacacaccggcccgtgcctcgaaacccaataaaactcataaaatccgacaacccattcaataacgagtccagccatactagttttacttaaatctaactccagttcgatgttcaaaactcaaaaatttatattaggaaactttaggccaatacccttaatttctctttaacgattcatcaaccaattgccaaaaatgaagatagattcatgaaatataaccaaaatggagtagagaacacaccccaattcatatggtgaagtttactccaaaaattgtctcaatatgagtcccacatctcaaaatatgaagaaaagaccatgaacctcgatttataggttctaccaacatttttgcaatcgcgaataagtggccgcatctgcaacttcgcttttatggaaaaagtcttgcatttgcgagatagcctcgaccctccagtggtcttttctgcgacgctcaaaattgcatttgcggtcacgcttctgtgcaaaatcttccgcatttgtggactctcacccaacagtacattcttgcacatgcgcaactgggcttgcttctgcggctatcgcacctgcgcaacaccagttgcatgtgcggaacaccataaccagtagctcagctaaaatccaaaatgcgatgaaatgatttgaaccttgtccgaaacacacctgagacactcaggaccccgtctgtctataccgacaggtccaataacataaaatggacctactcgaggcctcgaattacacataacaacatgaaaacgacaattcgcacctcaaataaaaaatctatgaactttgaactttcaatttccaaaactcgcgccgaaacatatcaaatcatccaggaatgaacccaaatttttcactcaagttccaaatgacatgacgaatctattccaattcctgaaaccacaatccgaatatgatatcctcaaaatcaacttccggtcaaacttatgaactttccaaaccttcaaatttcaaaattttgccaacttgtgccgaaaccttctagaaacatccaaatgcggatccgggcacatgaccgagtccaaaatcgccatactgacctaccggaaccatcaaaactccattccagggtcaaattcacaaaaagtcaaacttagtcaactcttccaacttaaagcttcaacaatgaaattcattcttccaatctgattttgaataacctgaaaaccaaaatcgacaattcacataagtcataaaacatcatacggagctactcatggccataaaatatcgagagaagtgaaaattctcaaaataaccggttggatcgttacacatatctatgaagaaggtagaccaaccaatgcaacaccaccaacttgggctaaatttttggaaatgtttttgaaatagtttgttccccagacactttgagatgcgtggcatacagagtttgaacggttgtgtcagggcactatgatagtgttaaaatatgctctcaggttcagtgagttaacccgtcatgcacctatcttggttcctacagtcagtgagtgagtgagcagattcattgatacttactaggtaccgactatggtgtaatcatactacacttctgcataattttgggcagagctaggttttggagatattggacccggacaaagttagagcatgatcgcaacgattaaaggtagagctctttggtcgttgcaatccattggagtctttccattttcattgtactgttaatttcctattcaaacaatattatatattcggtcctgagaacatttcatgtattcaattagagttcatgactcaatattaccagtcttttgaggttgatatatttgcttccgcttttggtttcgacactcgtattaaattatatatttttaaaaaaaaatagatttgaattgtaattgtaatcggcttaccaagttttagagaataagttccatcatgacgcctatggtaggattttgggtcttgacattctaggtcttccttatatgatcgcatcagcgagcgccagtataatgattcccatttgcttgtcctgaaggacacagttcatcacggtaatgctaaggatgttactgttgtatatgatctgatgttgaggatgcatggtcgtatttgtgtaccaaatgtagatggactacataagttgattcttgaagaagcccaaagtttgcggtattcaattcatccgggttccgctaagatgtaccaagacttgaggtagcattactagtggagaaaaatgaagaaagatacagttggatttgtagctaagtgtttaaattgtcaataggtgaagtacgagcttccgagactgggcggatttcttagagaatggaaattttggagtggaaatgggagcgtatcaccatagaattcgtaattggactccacagactttaggaatttctatgctatttgggtgattgttgatcggttgaccaagttcgtgcattttgttccagtcaatactacttatttttcggagcggttggttgagatttatatccgcaagattgttcgcctacatggggtgccggtatctatcatttctaatcgaggcacgcaatttatatcatagatttggagagcagtgcaacgagaattaggtacactggtttagttgagtacaacaattcacactcagacgaacatacagtcccagcgcactattcaaatactgaaatatatgctacgttcttatgttattgattttgggggttcttaggatcaggttttgccacttgctgggttttcttacaataacagctacaaatcgagcattcagatggcctcgtatgaggctttatatatgagatggtgatagttttcgatgggttggtttgagtcgggtgaggctaggatattgggtactaatttatttcaggatgctttggaaaaaggtcaaattgattcaggatcgacttcgcatggctcagtcaagacagaagagttatgtcgaccgaaaggtttacgatgttgcttacatggcaggagagaaggtactactctgagtttgcctatgaagggtgttatgagattcaggaagaatggcaagttcagtcctaggtataatgggccttttgaaatgcttaagaagactggagaggtggcttacgaactggctttgccgcctagtttaacgagcgttcatctagtgtttcatgtatatatatgctccgaaagtatgtcggatatccatctcatgttttggatttcagtacagttcagttggatggtaatattacttatgatgtggagctagtggccattttggacgggcaggttcaaaagtggaggtcaaagaacaaagcttcagtgaaagtacagtggagaggccaatcagtcagagagggtacctaggaggttgagcggagatgtagagcaaatatccacacctatttgaagctccaagtatgattctaaacccattcgaggacgaacatttgtttaaaagtgtaacgacccggccggtcgtttttagaatttatgccccgatcccctcttaactgtttctcctaagttcatttctgctattttggtttgtcgggatgttcggtattaggattcagagtgttttgggtcacatagtccccaattgagagcttaagtattggaaagtggtccataatcggaacagtgtgaagacggcctcggaatagaaatctgatggttgctccgttaggtgattttggggttgggagcatatccggaatgtgttttggaggtccgtagctcaattaggctagaaatgccgaaagttagaattttgaagttttcggtccgatagtgaattttttatccgagggtcagaatgggattccggaagttgttgtagcaccgtcatgtcatttgggacgtacgtgcaaaatttcaggtcaatcggatgagtgttggttaggttttttatcgaaagcgtattttggatgaacttgaagttcttaggcttgaatctttgatttaatcgagtttccgatgttgttttaggtgttttaaggattggtacaaggttgaataaggtgttagggggtattggtgcttttggttgaggttccgggggcctcaggtgtgtttcagatgctcaacgggcaaattttggtgtatgaaagaaaattgcagcaggccttctggtattttctcttctgcggcttgggaaccgcagaagcagcttcttcattacagaagtgatttcaggcatcttctcaggaaccgcagaagcggtccctttctccgtataagcgggaccgaagaagcgggatttgcaccgtagaagagaagtgtggccttaagtgaaaaaccgcagaagcggctcgtggtccgcagaagcggtcccatatccgcagaagcggaaatgactgttctgaaaagagtaaaatccgagggttaagttcaaacttagagaaatgaaaatttagctcagaaggaagcgatttttagtgggttttgaagagaagatctttgggtaatgttttcttggccctatttatttgtattccatcaatatctagttaaatccaccattaaaattcgaattcaagttcaaaattggggaaaacttgaagaaacttcttagacctaatgattgagttttgagtgggcatttgacctccgatttgggagatttttatatggttagactcgtgagagtgcgagggttctaaaaatgagaaaattatttgattccaagacattggcctgaggggcgttttggtcattttacctattttcgcgtattagctttcattttaatagtgaaatttattacttgcgatgttatttaagttatgtaactggattgaatagatttgggccattcggagtcggatactcgtggaaagagcgtagtttccacttgatgttgtaccggttcgaggtaagtggcttgtctaactttgtgagggggatctctccccttaggatatattaattcttgttttaaatgccttgtacgcgaggtgacgagcatgtacttgagctaattattgaaaattcattttatttggaatatttaaactgtgttttcttgcttatttggatgttctaaatgcaatctaacctgtgttagcctaagaaaagcatgtttagttgacttacttgcttacttgcctaaactgtattatttgtactccgtgaagcatgctagactagaaatttctactacctattcttacttagcctttgtccattacttgaattgttgttatgtgtttacaatttgggactacggggcggaatcccgggagctcccctgcacgtgttatgttctaatactgagagtgcgggataccaagagatccctggcacagatatgattatgaatggaggatgccaagagatcctcgggatactaggagatccctcatgtataaaatggaggaccccaaaagatccttgggatactaggagatccctcgtgtatgtgataaggataccaagagatcctcgggataccaggagacccccgatgctaaatatccggttgtgagtcgtatctctatttattgattgtgttgttctctgttactacttttacttattatttttctagattcacgctacagatcatactcatgttgtcttttcctttatcatattgattattatgttttatctcagtagggcctcgacctttcctagtcactacccgaccgaggttaggcttggcacttactgagtaccgttgtggtgtactcacacctcttctgcgcatgttgttcatgtgcagacccaggtacttcctcccaggtgtatcacccttgcagtagagagcattagtggagacttgaggtatatctgctacgtccgcagaccaggagtctctattctattccagatgtagcagatagcccctttccccttcatttcaagttgttttttagatactctggtgtagagcatattatgacactctattagcctgtgttgcccgtgacattctgggtttcaggattgtttcagaattgtagtgttgaaatgtatgtgccaggcggcaactatatacattccttatgttatttagctttaaattgtcatctttcgtaaaggtagttaaattccgtaatgtgttaggcttacctagtcgtgaagactaggtgtcgtcatgacgtggtcacgattggtgaactaggatcgtgacaagttggtatcagagctctaggttcataagagtcacagaacaccggccgatttattggagtctcgctgatcggtatggagacatctgtacttatctacgaggggctatgtaactgtttaggaaaaatcttcacttcatttgatttccttgtcgtgaaatattttttgataccaattctaaacttttgtcttctattctcccacaaattgtgaggacacgcgctactcaggatgatcaggcacccacaccccctcctgcagccgccagaggtaggggccggggcagaggccgttgatgcccgtgtggtgcggccagagcacctgcgcgagctgccgctgaggtaccgccagcagatccagtcggggctcacgcacctgacatgcctacagccactactactccagccgttcaggagtcattgacatagtttatgagcatgtacactacgctgtcgcaggcagggttatttccccttgctgcagccatatcccaggtcgggggaggagcacagactcccaccgctcgcactcctgagcagcgagtgcaggttgagcaggtcccagatatcatccttgtctagcctgcagcactagtccagcccgaggatggggcacctgctactgaggataagtagcggagactggatagtttcaagaagtatgaacctccagttttcagcggattagctacagatgatgccttgagatttctggaggattgtcgctgtatttttttcactatgggtattaatggatcgagtggggtttctttcgcagccttccagctttggggagccgcctatgattggtggagcacctttgagttagacagtctagacgaggctgcctctctgacttgggcaaagttttcagatatgttacagagggagtttgttccccagagcctcagggatgcatggcgcacggagtttgagcatttgcgccagggtgctatgaccatttcagagtatgccatccgttatactaggttggccagacatgcaccggctttggttgctactatccactagagggttcgccggtttgttgagggtcttattccacccatcagatctagcatggcttgggagttagaggtagacactccttatcagcaggcagtgagcattactaggaggatcgagggtttgcacgccagagagcgagaggagagagaggccaagaggtctcgagagtcgggtcactactctggtacccgtaccccaatagcagggcgtcatggtaggggctatatgggtctcccagttcactcagctcttccttcatctagcagtactccagctcctcccagatctcaggagccttactatgcacctccggtttctagcgcgcctcttgcgcgaggtgctttcagaggtcagtccagcagatctggtcccagtcagtcgtagccaccccgccctcccagagcttgttttgagtgtgggtacacccgtcatatggtgagggattgccctagacatgggaggagtgcacctccacaacattctcagccgcaacatgctcatcagagttctcaggctattgtcgcagctccagctgccaccccacctgcccagccagctaggggcggaggttggggaggtagaggtcgccctcgagggggaggccaggccagatattatgctattcctgctcgtaccgaggttgttgcctccgattctatcatcacatatattatactggtctgtcaccgagatgcatctattttattagatccaggctccacttactcttatgtgtcttcttattttgctccatatttgggcgtagcccgagattctttgagttctcctgtttatgtttctactcctgtgggagattctcttgttatggaccgcatttatcgatcgtgtttggttactattcgtggtttttagaccagagcagatctattattactcaacatggttgatttcgatattatcttgggcatgaactggttgtcaccccattatgctattcttgattgtcacgctaagaccgtgacgttggctatgccaggtatcccgcgtattgagtggagtggtactttagatcacactcccagtagagttatctcttttcataaagctcagtgtatggttgaaaaagggtgtgccgcgtatttggcttatgtgagagatatcagtattgatacccgttctgttgattctgtccccatggtacgggactatcccgatgtgtttccagctaaacttctgggcatgccgcccgattgggacattgattttggtattgatttgttgtcgcgcactcagcccatttccatccctccttaccgtatggctcctcctgagttaaagtagttgaaggatcagttacaggaattgcttggtaagggttttattcgacccagtgtttcaccgtgggttgctcctgtcttgtttgtaaagaaaaagaatggttctatgcgtatgtgcatcgattatcgttagttgaataaggttacagtgaagaactgttatcctttgcctcgtattgatgatctattcgaccagattcagggcgcacgaatgttttctaagattgatttgcgctcaggttactatcagttgaagattcgtgagccggatatcccgaagactaccttcaggactcggtatggccattatgaatttttagttatgtcatttgggctgaccaatgccccagcagcctttatgcatttgatgcacagtgtgttcaggccatatctcgactcgttcgtcattgtcttcattgatgatattcttgtttactctcagagtcgggaagagcatgagcagcacctgaggacagtgcttcaggctttgagagaaaagaaattgtatgcaaagttttcaaaatgtgagttttggttggattctgtggccttcttgggtcacgtggtgttgagcgagggtattcgggtggatccgaagaaggtagacgcagtgcagagttggcctagaccttcctccgcgacagagattcgcagttttcttggcttggcgggttattaccgtagatttgttgaggggttttcttctatcgcagcacctatgactagactgaccccagaagggtgctccgttccagtggacggaagagtgcgaggcgagctttcagaagctcaagacagctttgactacagcctcagttcttatattgcctacaggttcgggttcttatactgtctattgtgattcctcgaggattgtccttggagcggtattgatgcaggacggtagggtaattgcctacgcgtccagacagttgaaggtacatgagaagaattatcctgtccatgatcttgagttagctgctattgttcatgccttaaagatctggcgtcactatttgtacaacgtgccttgtgagatttatactgaccatcggagtttgcaacacttattcaagtaaaaggatcagaatttgtgctagagaaggtggttagagctgttgagagattatgatatcactattttgtatcacccgggcaaggccaatatagtggacgatgccttgagtcgtcgggcagagagtttgggtagtttggcatatctaccagcatcttagaggcctatggcgatggatattcaggccttagccagtcagtttgtgagattggacctttcagagcccagtcgggttctagcttgtgtggtctctcggtcttcattgtttgatcgtgttaaggagaggcagtatgatgacccccacttacttgtcctcaaggatagggtcgagcatggcgatgccagggatgtgactattggcgaggacagggtaatgaggatgtaggttcgggtgtgtgtacccaatgttgatgatattcgggagttgatattggcagaggctcatagttcgcgatattccatccatccgggtgccgcgaagatgtatcaggacttgaggtagcactacttgtggaggtggatgaagaaatacatagcagggtttgtagctggatgcctcaactgtcagcaggtaaaggctgagcaccagagaccgggtgggttacttcagcagattgagattccggagtggatatgggaaaagatcaccatggattttgtagtttgtctccctctgactgcgaagaaattcgattctatttgggttgttgtggatcggctgaccaagtccgctcatttcataccggtgtgtactacttactcagcggagaggttagtggggatttacatcagggagattgtccgtctgcacggtattccagttactatcatctcggacaggggtactcagtttacatcacggttctggagagcctttcaacaagagttgggtactcgggtgactatgagtatagaatttccccccagacagacagacagtccgagcgcaccactcagattcttgaggatatgctccgtgcgtgcgtgatttgagtttagagggtcttgggatcagttcttgccattgacggagtttgcttacaataatagttatcagtccagcatacagatggcgcggtatgaggctttatatggtaggagatgcagatctccggtgggttggtttgagccgggtgaggcgagactattgggcatagatttggttcaggatgcgttggaaaaggttaaggtgattcaggatcgactccgtacagcccagtccagacagaagagttacgcggactggaaggttcgtgatgtttcctttatggttggtgagcgggttctgcttcgggtctcacctatgaaaggtgttatgaggtttgggaagaaagggaagttgagtccgaggtttattggcccttttgagtttttgaagcgagttggggaggttgcttatgagcttgctttacctcccagtttggccggagttcatccggtatttcatgtatcgatgcttcggaggtatcacggtgatccgtcgcatgtgttggagttcacttcagtccagttggacaaggatctgtcctatgttgaggagccagtggcaatgttggacaggcaggtccgaaagctcaggtcaaaggatatagcatcgttaaaggttcagtggcagggtcagcaggtcgaggaggcgacttgggagaccgagcgggatatgcgtagccgataccctcatcttttcactacttcaggtatgttctctatgctcgttcgaggatgaatgaatgtttaagtgtgggaggatgtaacggcccggccggtcatttttagaatttacgccccgatcccctcttaactgtttcccctaagttcatttctgctattttggtttgccgggacgttcggtattaggattcggagtgttttgggacacttattagtccccaattgagagcttaagtgttggaaagtggtccgtaatcggaacagtgtgaagatggcctcggaatggaaatctgatggttctgttagctccgttaggtgatttcggggctgggagcgtgtctggaatgtgttttggaggtccgtagctcaattgggctaaaaatgccgaaagttagaattttgaagtttccggtccgatagtgaattttttatccgagggtcagaatcggattccggaagttgctgtagcaccgtcatttcatttgggacatgcgtacaaaatttcaggtcaatcggacgagtgttggttaggattttgatcgaaagcgtattttggatgaacttgaagttcttaggcttgaatctttgatttaatcgagtttccggtgttgttttaggtgttttaaggattggtaaaagtttgaataaggtgttagggggtattggtgcttttggttgaggttccgggggcctcgggtgtgtttcggatgctcaacgggcaaattttggagtttgaaagaaaattgcagcaggccttctggtattttcgcttctgcggcttgggaaccgcagaagcggcttcttcatcgcagaagcgattccaggcatcttctcaagaactgcagaagcggtccctttctccgcataaccgggaccgcagaagtgggatttgcaccgcagaagcggagtctggccttaagtgaaaaaccgtagaagcggcttgtggtccgtagaagcgggactgcagaagcggtcccttgtccgcagaagcggagtgactgttctgaaaagagtaagatccgagggttaagttcaaagttagagaaatcaaaatttagctcggaaggtagcgatttttagtgggttttgaagagaagatttctgggtaatgttttcttggccctatttagttgtgttccatcaatatctaattaaatccaccattagaattcgaattcaaggtcaaaattgggaaaaacttaaagaaacttgttagacctaattattgatttgagtgggcatttgatctccgatttgggagatttttatatggttagactcgtgagagtgcgagggatctaaaaatgtgaatattattcgattctgagacgttggcctgaggggcgttttggtcattttacctattttcgcagattagctttaattttaatagtgaaatttattacttgcgatgttatttacgttatgtaattggattgaatagatttgggccattcggagtcggatactcgtggcaagagcgtagttttcacttgattttgtaccggttcgaggcaagtggcttgtctaactttgtgtgggggacctctccccttaagatatattaattgttattttaaatgccttgtacacgaggtgacgagcgtgtacttgagctaattgtttaaaattcgttttacttggaatatttaagctgtgttttcttgcttatttgcctattctaaatgcaatcaaacctctgttagcctaagaaaagcatgtttagttgacttacttgcttacttgcctaaactgtattatttgtactccgtgaagcatgctagactagaaatttctactacctgttcttacttagcatttgtccattacttgaattgttgttatgtgtttacaatttgggactacgggacggcatcccgggagctcccctgcacgtgttatgttctaatactgagagtgcgggataccaagagatccctggcacagatatgattattaatggaggataccaagagatcctcgggatactaggagatccctcgtgtatgtgatgaggataccaagagatcctcgggataccaggagatccccgatgctaaatatccggttgtgagtcgtatctctatttattgattgtgttgttctctgttactgcttttacttattattttgccagattctcgctgcagatcatactcctgttgtcttttcctttatcatattgattattatgttttatcttagtagggcatcgacctttcctcatcactatccgaccgaggttaggcttggcacttactaagtaccgttgtggtctactcacgccttttctgcgcatgtttttcatgtgcagacccaggtacttcctcccaggcgtatcaccctcacagtagggagcataattggagacttgaggtatatatgctacgtccgcagaccaggagtctctattctattccagctgtagtagatagcccctttccccttcattttacgttgtttttttagatactctggtgtagagcatattatgacactctattagcctgtgttgcccgtgagattccgggttttcggattgttttagaattgttgtgttgaaatgtatgtgccaggcggcaactatatacattccttatgttatttagctttaaattgtcatctttcgtaaaggtacgtagttaaattccgcaatgtgttaggcttacctagtcgtgaagactaggtgtcgtcatgacgtattcacgattggtgaactaggatcgtgacaagttggtatcagagctcacgtgagttgtccgtgcgtcacgtgagttgtccgtgcatcacgtgagttgtccgtgcaatgtgtgaaacttgtagtttctcaatcattatctgatttacttattttctttctcccttcatgacataatattgttaaccaggatatagttgtactgaattaaccggtgaattcaacaaattaagcttctcttaccttttcatgtttatttgcgatacttattgagttggttgtactcacactacaacatgcaccttctgtgttgatccaggtacttccgaatacagcgcctgctagattcgtggattcatctgttagagactatcgaggtagctgcttggcgtccgcagaccttgactctctcccttttcagttattgtgttgttctatattttcagacagtatttcttttatttgtcaaacaatgtcgtgatttagatgctcatgtgctccgcgacacaggttttgggagtgtatttgtatcaataattatgggattttctgttaaatttaaatattatattttcaaacttaaaagaaatcatggtttaatgaggttgtcagcttgcctagtattgagataggcgccatcacgacatgtggaattgttggtcgtgacactttcacaaaatctttgggaagaaacttaatatcagaaacatcgaggggaatgagactattgccaatttgagttatatcaacgatgatggtaacccaacctatgtgattgaagatcccgcgaagtaggttcatatgggtaataacaagtcattagttgattaaatatgcactattaaattatgtcacttcctatggtgcgtgtatatagtgagagactgcaaggagtggaagggttattaaactctaaatctaataatccataatcttttataggtggtgtatagcgatgtagattacccttgatggatgtacctatatgagtgtggagtgtgaccgctcctatgaaatttatggcaaaaatttttagagaactcataaaaacaggcgcgcacgtggcctattagcgcaaaactacgacaatcgacaaagtgtgcgcgagaatagtgtgatagataagatactaaacttacaaaagaattcttggttcgtagaaatcctaaacttcaccaattgttctgtaagtttaatcttagtttatctaggttctggttcatagttcaagagacactcgatttgacgcattatgcccatttatgaaaatccagtaaaaaattttatttcactatatttttaatatttttttgagatatgtgcgggacagatagaaaaattattttaatatctcaaaaaaaaaattattttaaaatcatgtctagattctttttcttaatattatattaatgagtctttattatagcaacaaaaacttaatttatttttgaattcgattgggacacaatcaatcagacaattcaatacttattagtatggatttgtacgttagtattgaaaagccaatgggttaagatttaacgtattcaggaattttctttatggattgaacgtttctatggcaacttctttgaatagtctgtaatatggaaccagaccgtctacttctcttttagaatatatgtacctctttgtcttcatgttagaatgtagtgaacagagttaaaaacttttcttaccttttcttttgtgcggaattttcttctcattaatctttgttgtttctgctcctagttatagtagaagagcttgttgaatcctgggaatacgcttaataataatcatcacagtgtgtgaaatatccttaaggataatcttcttgacacgcctcaagctaaatcttattcccctcagaaattattagtacctttctattcagtcaaagttaagtactcaaatcatactataaatagagccgaagaatgcatcaatttctccatccttcaatttcaattatcataactaagttttaacaaaagatgggttacgaggcatttctgtttcttggcctttttttggccatttttgtaatgataagctctgaggttttagctagggagttggctgagatttccaccatttcagaagaggactgtaagaaccctctcattatttgcatatatgttcaattctctacttaattcaatgttgtcctatttttatcttgtgaaattatttaacctttccaattagagtttaagtggtcataaagatactatttaaatcccattaaaacaagtaggtactaagttgtataattactaggataataataacaatacattaattgtactactgttagcttgaccaagatagaggcgggtcttcaagaggatgtgtgtactattataaagagacggattaaaaatttacatttaacgtacttaactttaggtatatttttaaaattataggttcaaaattatattctttttaaaagtttagatattcatacacctcgctttatatgagggataagggatacttaatccggggattaaattttagataagttttcaacgtttggttgggataatataatggtataactgatcccacaattagttattccaagattgttgcattatttttatatctatgggagggtggaataataattacggaataattaatcctgaaaaagcatattttaagccttctaaaatataaccataaatcttacaactttatggattacatattttcttcgtaattctgtgtaaggatcacataataagctaaaaaaaggaagagtaataaagcaattaaagaacaacattcttattttcacaattgatgcagcaaagaaatccagtaacaagaatgaagtacataaagctcaaaacgactatggaggaaaccctgtccccggataccactgaccctggcggaggcggaggaatttacgctactggtggcggatatcctaatggcgtccgtggtggtggtggacgcggtggtggtgaaggatactggcgctatggttgctgcggccgccggaattacaatggttgcagcaggccggtgctgctcctacaaaggtgaggccatccatggataattaggtcactatactgaagctaagcctcacaacttatcatcatgtggagcaacatataaaacctttgtactttgtaaaccctcaagatgtactagtaataatcttgcagctttttagtgcctgttgtaacaagttatgaataaaattaagtcatcatttgtttggtataacagaaatgttttccaagaaaatgtttcattggaaaacaagtagtcattttattcatttttcgttatttggtacgcaaattaagaaaaatgacttctcaagagtattcataaataatttagatataataaacatgaagccataaacttttaaaccaacaatcttccggacccacaaatttcacaaactttcaaaccgctaaactttcaaaactgcagaatttcgaacccgtaaactttataatttctaaacccgtaaacttcgaaacacatcaacctccgaactcatatttttggaacttgtaaaatttcgagtctttaaaccgataaataataaaattaaaactgaaaatatatatttaaaaaaaatttcgggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttaaaactgaaaaaaaacctatattatatatataaatctcttttttaaaattagcacattttatatatattgagcacattttaaaaaaaatattatatatataaaacggaaaaggcctaaaggagtataaaaaagagatttatatatataatataggtgtagtaaccgaagtcaaaaagggaagagtataaaagagatattttaaaaaaataaaaatattttttctttataaaactgaaaagatttgtgtaacaactaaatttcaattcctgaaaaataataatcaagacaagaaaaatagcgacaaatattatatttaatttcaagtgatggggttacaatctctagaatatctctaaatctaaagagatgttgtcctctgattcttctcctcacggatgatggttcaagagcttgaaagcttgatctcgaacttgacagatttcagatttgtagtacgtcacgaacaatttgaagctcgtcacgagccaggattgatgttgggttatcacgaaccgaagatttgaagccgcccgcctatgacttgagttcgcctttggaatttgaccacagacgacggttgcagatatggaagaccttgatgctattcctcagagcttctttagcctttccttctgcttacttgcttgtgtcttagccctctcccttgacccctttatataggtgtggggtggagtagtctccaagaaaaccctagtggatcattgggcttgaggcttatgggccgacttatttgatagaagactaatttgcgggctagcccaatagtacattggatatttatttaaatcaatttaattggatttaaataacaaacccaattataccagtccgtgttacttacttggaccaatatatatttaatttgtggtaaaatccaaattttttatggatttaaatttgacaaaattttaattgtctacaaatgccccctgcttcaaggcttgtcggggtgtaggcttgccgaaatgagtggcgagacttgaagtaccagtgatgatgacaatatttctcgcatcattttgtaagataccgcactgatagttgtttacatgttctatttccgaggagtgaattgatgttgtgaatcattggaattggcagctcttttacttcattcaaagtgagccaaaacgacccttaatagcaagcttggctcttgtagcttaattctccttctctggtgagaaaataaatttggtggcctttcttatgtagtatcaacttaattgaagaataattaagttcatatcgaactaaatcaaacacatccacccacgacaaattaaaatttaaaccgctggatttacgagaaacatttggtttattcactcgaattccggttcaaaagatatgctttcctttgatgcacttggaacatactctcacaacatagtgcttctccaatttggctgctacaataatatatttcccttgctcgtcatttcctcccatgaattggagagactccacattggccggcattagtagtactacaaaatgatctctattaccttataatggaacatagttcagtctgaataagatacgtagtactacatagtcataaaacaaagattaaaacctaagaacccataataatgagttcttttggaacaaacttcaccatcgcaaacccatcctcgtttggtttcttttcatctttgcctagatatgtcaaagtagtattagtcgagttcatttagctcgaacatagcatgagaattttttgggacaactctctccctaccggtgtgtctgtttaggatctcccgtgagtttggagaggataacttgtttcaaaattcacctggcaagtattaaaattccttgctctggccaatatgtattttactatggatatttaccaactgttatttctcttcttgcaggaggaatttattgaatgttctggaatttctaaaagaaaagccaaatgcttgcactcttgtgtcgggaacaagtgacagagtcaatttgcacgacaaatttaagaatgccattgaagcatatcttcccagtactattgatgagttgactctgaaagacgaggagaaaaaaagagcccagcagaagaaaccttccttctgggagtcatttgactacatcaaacatagaaagttttaatgcattccccactgtccgatggcatcaaacatggaaaattttaaaactttccccactttccctgggctgacaataagtttccttttctgctttgatttcctagtttcaaacctatttatgtacaaatcagacatgatttttccttatttgcacatgttagtagcttgaacaccaagaatttccttaatttcttccttgttggttcctataaattgaccactttctgcttgtatcgttaccatagcagtagtcctccgctctttgatgaaatcaacagtactgctttttggttggatttaaaggtattcttcaatcgttagcgacgcaatcccgtcgctcgattctcctaacgatttttttgtgcagttgctgccaggaatttcagctttgcgcgtcttaaccaaaaaaatcatatcttggtgtaggagtatcgaaatcacgagtggtttgcggctacagaaactagacttggagtaatacaacgtaccaaaaatatggatttaaattcgtattgtatcatcccaggtgagcttcgtaatcttggttcaagttctgtcattgctcgatattccagctttgcgcgtcttaaccaaaaaaatcatatcttggtgtaggaacgccgaaatcacgagcggtttgcggcgacagaaactagactcggagtgctgcaacatatcaaaaaatcggatttatgttcgcatcgtatcatcccaggtgagcttcgtaatcctggttcgagttctgtcattgctcgatattccagctttgcgcgtcttaaccaaaaaaatcatatcttggtgtaggaacgccgaaatagcgagcggtttgcggcgacagaaacgagacttccagagctacgacataggtaaaaatcataatcagaatatgctgatatattcccagatgttttctcgaatttatgcaacatattaagacatactgccccattctgtcctgctgtcttttttttatggattcttcccttctttttttttttgcagactctccgagcagcacatagggctgtgaattccatcagcaaggatgcgtttcatcgaccatgatacaccatacccgcaacttgagattattagcgacaagcagaatccgcgcgcccaagttctaactttaaaagttcatcctccggtgataggtgctttcctgctcgctaggaagccacttgacgcctcccttgatcttgcagaatggtcgactagagagacgaaggacgcattggacagattttcgggcaaagcaaccagcatgaaggtcctacttttgaagtcctccacccatcaaagggtcgtatctgctagtcctcttcattgtgatcacgacggacgtctcgccacttggatcgttcctccttccggctttggtgaagttcgctatacgtccaaatattgggagtgggtagaagatgttcttgctcgcaacaagttgactttggatggcatcaaggtctatgacgccatcttttcttcgttgttcacatatgactacaatgagaatgtcctccgtgccttttgtgagctttggcgtccatctactaacacaatttctacctctattagtgaactctccatctctttgtgggacttgcgagcaatcggaggcctcccggtgcatgggtctttctacgacgaagttatcccctcggcaaaggagttgacacaagaagacgatcaaggaaaacctttcctcccaagaagttgtctgcacctgttttcggcattctacagactcatgaaggatgatgtccaggaggtctccattcgtgattgggtggagttttggtttcgaggcccgagtaggtatgccaagcctccgcaaaaatcatcgaggaatcggactacaaggccgaattgaatcataatccttcaggaaatattgacgcgagcttcctaccacgaaccgatgaggagaacgccccctttattgagcttggcgtggaggagtcacttagagctgagacttatttggcggctttccttgcatgttggctttgcaaatttgtgttccccaacaagaagactgactacattcgtgctagcgtcttcaaaattgcgagtttgatggctcatggagagaagttttccttggcggttcccgtccttgcaagtatttatcatggcttgaaggaggtctccacttctcaagatttgggcgcctgcaaagcactctttcctattcattatgtatatggatggataggagcatattttgacacctactatcatgttaagcgtccacaacgaggtccgcagatgtgcaaagtttctggcgagaagatggctaagcatttcgaccttagcaatgcccgtgagttgtttcaacaagttagtgcgcgacagcttcaccatttggctatgctacaagggagggaattgcatcttactgatcgtgacgaacaatcgaattcttggagtgacttttttataagtcttcgctcaagtttcatcacccttaggcaggatgacattcatattgtggaaccttatagcccgcataggtttagtcgtcaattcggcttttgtcaagatgttcctggcaaactcatagagcgaccctataacagctcactgaaaatgctagtgcaattctgggactcctgtgttcgtcttggaggttcatcaaaggttattgtccctacgcgtccatcagaagagggacctctaatgactcgtgagtatgcagattggtggtcagctcgtcgagtgcactcttcccgacaaagcactcatatcgttttgaaagttccaaggaaagatgatattccattatcctccaaagatgatcaacgtcaaaagaacactcacgaagggtcttccaagtccaagttaagatcaaaagatccttcgccaagcaccaaggtcttatccaagtctaccccttcgacgggcggggatgcccatgtggacaaaggagctaaacatgttttgttgacttccaagacaactactgccacggtggaggtgacgagcaatccttgcaaaagaaaagcgcctcctacttcgccaaacaaaaatgttgctaagacaaccaacgttgtgccaacaaacgaggaaaggactcaagcttctgctttgcccaacgagattttgaatgttagtgcaacttccagttcaaacgagagtgatgttagtcacgacatacattggaatcgttcaaagaagaaggctaaggacatgagccataatgagtttgctgacttggatgctcttagtatcgatactgaatttttcgtagagggtgaccctggctcgacgatgccgttgtctgaactggagaaacgggtaaatattatttccttcaactttactccctttctcttttttttttttgaacgctaaagtttttttttttttttttgtttcagttgggcgtcgatgagttgtatgatgatgtacttggtgacgacatggtggaagactgtgttacgagcccaaattcccttggtgtggccgcaaaaaatcctcacccttcatctaatggtgctgaaaatcatgctgcgaacaatgctccatcgacagacttgagtctacccaaagagtcgcaccttgttcttccagaagatgttgtgcttcccacgccagccatggcgagtaagatggaggttgctgcaagtcaagcaaagcatctaaaagccttcgagcctactccatggccattgcatcttgatgctccaaacttcaagccacaagagaccatttctcgtattaaaatttcttttgttaacacgatgtggcataccttgtgtgaatggatcgaagagttctctcttgattctctagatagcttcacaaagttggaggaaagtattgctttgagtcttgaggaaattaagaaagaaaatgttattgatacttctaccttagagactcttgtcgaggctttcttcaagacgtacgcagattacgatgctttaagatcgtccaagatgactaaggaatttcaccgagagtcactttctgatgcacgacgacgcctcgatgatgcaaaacaagaatatgaaaaagtgagcgagtctgtagaaaaacttcaagccagtcttgcgagtgttgaacaacagctagcttccttggcctccaaaaagaagaagatcgtcgcgctcttgggcaaacgacaggtgaagttggctaaaagtcaagagaacgttgacgttaccgaaggggagatttataccatcgaagccaatcatccattatctgacgatgaagcagagaaattatccttcctgaaaggggcaatcgagacaagccgccaacaaatccttagcttcaaaccttttccatgattttagagcttttttttttcattaggattctcgacttgcgatttaatatcatgtaatgcgcacttatctcttggagcaatagaagtatctttatttattttttaatatgtgatatttccttttgagacttggattccctccgttactcccaattacttccttcttaaatttcaacgtatgccttgtatgttggttttgttgtttcgcgaaaaagaattcatattttactgtaggagacttcaaatcataagccgcttgcttctatcgaaactagactcataggactgaaacatatcaaaaaattagcacgaatctccttttgtatcagctggaatttattttcaaagtcgatctacacgcctggcccgtgtttagctcatagctttgcgcactctgcgcaaaataaatcgtatctcgagataggagcatccaaatcacaggccgtttgtggtgtcagaaagtagactcggagatctaaaactcatataaatttcgtagcagatctctttttggattgtgaacagaaaattcgcgaagtcgactcaactgcagtgaattttcagatctgcgtaccttcggcaaaaatgattgtatcttgagcttggagtgtcggaattgcaatccgtttgttccgttagaaagaagactcggagatctaaaactcatataaatttcataacagaactctttttggactgcgaacagaaaattcgcgaagtcgactcaacggcagcgaacttttagatctgcgtaccttcggcgaaaatgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctttttttttttttttttttttgagtgtcgttcgcagtttaggctcatgcgggccaggagcattgcagcgtgcagtttaagctcatgcatcaaggagcgtcatgacttgcagtttaggctcgtacgtcgaggagcgtttattcttcaaggatagtacctcttcaaaaatttcccgttgatagggccaattctcatgccgtccgcatcaactatcttgtaagctccacttgaataggcttcttgcacaacatatggaccatcccactttgaggtgaatttgcccccagatttgcgagaggtgataataagtcttcttactgcaagaacttgatcgccaacttggaaggacctcaagcgaacctttttgttgaaagcacgagaaagacgagcttgataacattcaagactttgttgagcttctagtcttttttcatcaagggactcgagctcttcaaggcgcaggcgagcgttttcttcttcagtaagaccttcttggacagcgagttgcaaggacggtatttgacgctcaagagggagaactgcttcgactccataaacaagagaataaggagttgcttgcgtcggcgtgcgatgagtcctacgatatgcccacaaagcttcttccattctatcatgccaatctcttttagacttggagacgaccttctttaacaagttgcaaagtgtcttgttaaatgcttcggctagtccatttgcagcagtataatacattgacgaattacgttgcttgaagccaaaaagctcgcagatcttggtcatcaatttgttatcgaatggtttgccattatctgttattatatagctaggaataccgaaacgatatatgatgttgactcgaatgaagtttgccacgttctctttcttcacttccttgagagcgacggcctcagcccattttgagaaataatcagttgcggccaagatgtatagatgtcctccagaagattttggaagtggcccaacaatatctaatccccaagcatcaaatggccaagatgcaaccgtaggatgtaacacttcaggtggttggtgtataaaattcgcgtgaaactggcaagccttgcatcttcgagcataatctaggcaatccttcaccattgtcggccagtagtaacccatcctctttatgtggaagtggagcttcggcccagattgatgtgatccacaaactccaaagtgtgcctcttgcatagcttgagttgcttcatcttcccctaaacaacgcaagagaactccttcaaatgatcttcgatacaaagtgtctttgtagtaaaggaagcgaggggcacgccgacgaatttcggtctttcttcttggatcttctggaagtatcccgtaacataagtagtcgatcatggtttgtcgccaatcaaccttcacagcttcggcgacggctaccaaatgctcgagcttgctttcttcatcctcgttcccatctggcggcactatccatttttggcagatagtgatttgtgtctggccgggtagagtcaatgtcgaagctagtgcagctaagccgtcagctttcttgttttccttccttggcacatgctgaagagttacgttgccaagccatccaatcaatttctgtgcataatcataataaggacgcaattccggctttttgacctcgtatctacctagcaattgattgatcactaactcggagtctccaaaaatatgtaattggagttgtctcatatcaacggccatctcaagaccaagcatgagtgcttcatattctgcaacgttgttagtgcaatgttgtgttaaggtgaaggaatatggcaagacttcccctcgagaagtgacaaacacaacacctgcaccagctccctcgcgatgtgcggcaccatcaaaatacatttttcacggtggttgcacttcgacgaccatcgcatcctcatcaggtagttcatcagtcaactcccaatcatcaggaattggatgatctgccaagaaatctgccaaagcttgtcctttcacagctttttgtgggatatacacaatctcgaattgttgaaattgaagataccaccttgctaatcgatcattgaggacgggttttgacataacaaacttgatcgggttcgcccttgagacgagacgaatgacatgagcttgaaagtagtgcttcagcttttgaattgcgaaaaccaatgccagacacaacttttcgatcggggaatactttagctcatttggggtcatcatcctactcaagtagtagagggaattttctttattttcactattttcttgggccaaaagggctcccactgacctttcttgggccgcaatatatagaatcaatggctttcctggtataggagctgccagaatgggaggtttcatcaagtaagatttgatgctttggaatgcattgctacaagcttggtcccattcaaaaggtacacccttcttcatgagacggctaaaaggttggcacttccctgctagatttgagatgaaccttctaaggtacgccaattttccttgtagacttttcaattcatgtatatttctgggctccggcatcttcaagattgcatcaactttggcttgatctatctcaatccctcgatgtcgaacaatgaagccaaggaattttccggaagcaactccgaaggcgcatttcaaagggttcattttaagttgatatctccggagtcgttcgaacaccattcttaggtcttgcaagtggtctcctctctttcttgatttcaccactaaatcatccacatagcattccacattcttgtggaggatgtcgtcaaagatattctgcattgccctttgatatgtggtgccagcattcttcaagccaaaaggcattactttgtagcaataaatgcctttatgagttcgaaacgtagtaagctcttcatcttttggtgccatacgtatttgattgtagccagatgatccatccatgaaagacatcgcctcgtacccggtggtggcatcaatcataagctctggaatagggagcggaaattcgtccttagggcatgcattattgaggtctctaaaatcaacgcaaactcgaatttggccattcttcttctttacaggaacaatgcttgaaatccatgagggatatttaacctcccgaatgaaaccagcttcgatgagtttattgacctcggcttcgattgatgggatcgattctggcctgaagcgtcattgggcttgtttaacaggacgagctcctttcttgactgcgagatgatgaactgctactttaggatctaaaccaggcatctctttgtagctccaagcaaagacatctctatattctttgagtagctccacataagtgttttcttcatctgtggttaatagggcacttacataggtgggcctggattcttctgcagtgccaaggttgacttctttcaatgcatcaacagtcattttaattccttcttctagttcagcaggagcgtcctcgacatcttcgtcttcttgaggatcaccatcactaaaagatatatggccacaccaaaaggcatctcctaaatattcgtcaactttccttagggatgaaatgtattgctcctcatttgcagtaatgtgatatgaagaccctacactttcttcgtcttcttcacgctctctagtgtggactactgtgcgagtcttcactttgagtacctctccgcatgaaatcaaaagttctgattgtcgcctcattctggaagggatcaggctctggcactctttggagatacttagacctctagatggaagaggtcttcttatttcttcataatttctttgggacttgttcttcttccttttcaatggccccaacctctcaaatacagaagttcttgtagttggttctccaagtcggtcaaagacagaaggccttttattaggatcagcgggttcatcttccgtcgtgatatagctaatacttgctcttctaatggagatgcgaactggagggggttgtttgtagcctagaccctcacgtgattgcttcaccacatactccttatcattcatcgtgtttgctttccgagtagcttcaggtgggagcttccctagtttagatggttcattgggatcatatccagcctttgcgaacaacctataagcattcggatcaaaaccttcatttgtgcatttcgtagggagtgccttattttgaggcgtgtcaggggccacgaaattttccgattcccttgaggataaatttatggtatcaatttgcttgataggaagggttaattcttttagtgcacccttttggaggcttgataattctccttcatccttcttcacttttgggatgtaacgaaataaaggagctattttcttgcctttggtcttcgtgatgtcattagcttttactcccttcatgacgtggttcttcaagtagaactttgcatcagcgaagtatgcctcggcttcggagaacggcttgtcgtcggcaattatcttcttctcgactccatcttcattatatttcaaacattggtagtaagttgatgggacgactttgttctcgtgtatccacgacctgccaagcaacaaattgtatgaagtctttgcatcaatcacatgcatccatgcagttgattgcatatctcccatggtgatttccagcttgatagctcctatggccctttgtcctccttgattgaatccctgaatcatcaatcggctttcagaaagttcttcagttgagatgccgagttctttcattatgcgaatagggagaatgttaactgcagatccatcgtctataaagattctgtttatcctcctctcgagcacataacccaccataaacaaagggcgattgtgttgtgtctcacccagtaggagatcgtctgcagtgaaggtgatttttgtagtacatacatctgcttcttgggaggaggactcgacaagactattagacagtgatggtgagagtgttgacttgacttcattcttttcttcttcttctttatcagcattacagcacaaggccttgtcatcatcgtcaaaaatcctcatgcgaaaccaacttggcaaaaattctcccaaagtcaccgggtggcgtggcttttggtgatggtgtgcatctatctccaccttctttgggttcttaacaatttgtagcttctttggtcttctcaccatcttattcctcgtaggtttcttcgttgatcctttttgcggactcaatttacggcgtcttcgacgagtcactagggtccatccttcttcatcaggtcgatcaactcggactttgtcatcctccaacaattcttcatcttcattcccttcataggtgcatatctcgatcggatcaaatgagccaaaggtaatggacacatggtttgtgcttgctttttcgtcttcgagctcgatcttcttttgacgggccaaatccataactttatccttgaaaacaaatcacttctcgagaggatgacctacaagccgatggtatttgcagtaattcgggtcattgctttttccagcttcatctggtcgcttcatctctggaagctcaataagctttaactcgaggagttcttcaaatattgcaggcacgtcagagtctagaaatgggtactccttctcttgcatctctttgagagtcaacctccgatttgcattgtcttgagaggaagttgttttcatactctgtttcttgctcaccttggtagtaaacttcaaaggagaggcattgacgttcatggattctttgctttcattcttgggtacgaacttgctccatttcttgacttcttgcttatctcttccctttctaggttcgtagatgggcagcccttcgcttcccgcagaagccatgctcaactccatatcatgagcacgggtggcaagttcttcaaatgtcctgggcttaattccttgcaagatgtaacgaagtccccaatgcattccttggatgcacatctctatgccagaagcttcgcttagcctatctttgcagttaaggcttgcattcctccatcgattgataaagtcaataactggttcatcttttcgttggcgagtattcgtaagttccaccatgctcacggtacgcctcgtgctataaaagcgattaagaaactcttgctccaattggccccaactatcaatggatccagcctcgaggtctgtgtaccaatcaaaagcattcccctttagtgagcggacgaactgcttgacaaggtagtctccataagtccctgcattgttgcatgtctcaacaaagtgcgcaacatgttgctttggatttcccttgccgtcgaactgttgaaatttgggaggttgatagccgccaggcatcttcaagctatcgattcttgcagtatacggcttggcgtacgtgagagaagactttgaagcgacctcatacttatccttgatagttcccataatgaattccttcaattgttctatgggaattgatccttcagaggagacatgaagttctttggcggatgacccttgttttgttggaggatcagccttctcgtggatttcaggaagctttccaggtgcatgacttgattctccatccatcatgctttcaactatgcctgttaattttgcgatacggacaacttgatcttgagcatactttgttaacccatcaatcgcctttgtcaggtttgcaagttgctcctccattgtcgaagtgttagtcatcattgcctccatgattattgtagatgatgaagaataaccgagaccttcctacagattgaactcagtctggaacacgtcatgtggcgagattggcgtagagccgacacttaagacttcatcatcaggttgggtaagctgactcttggtgttgtataaagtgagttgagcaagagctttctccacaacttctgcaatattatctcctctctcagacttgctagcagaggaccttccttcttcgaatgatgaagatctcaaagcatgcattggcgcggacgacacttggagtgcttgttgccccaagacgctcgccttgctccgggtgattggaccaagactccccttagtaacgttcaggatactttcaacgtcagaagaaaacttggagtcagcaactttcgggtcgatcttctttgaagccatctagtgatcttgaatgttgagagttgagaagagatgagaggtagagatggtcccactgggcatgccaaaatttgtaacaactaaattttaattcctgaaaaataataatcaagacaagaaaaatagcgacaaatattatatttaatttcaagtgatggggttacaatctctagaatatctctaaatctaaagagatgttgtcctctgattcttctcctcacggatgatggttcaagagctagaaagcttgatctcgaacttgacagatttcagatttgtagtacgtcacgaacaatttgaagctcgtcacgaaccaggatttgatgttgggttatcacgaaccgaagatttgaagccgcccgcctatgacttgagttcgcctttggaatttgaccacagacgacggttgcagatatggaagaccttgatgctattcctcagagcttctttagcctttccttctgcttacttgcttgtgtcttagccctctcccttgacccctttatataggtgtggggtggagtagtctccaagaaaaccctagtggatcattgggcttgaggcttatgggccgacttatttgatagaagcctaatttgcgggctagcccaatagtacattggacgtttatttaaattaatttaattggatttaaataacaaacccaattataccagtccgtgttacttacttggaccaatatatatttaatttgtggtaaaatccaaattttttatggatttaaatttgacaaaattttaattgtctacaaatgttaattttttatggatttaaacttgaaagcttgatctcgaacttgacagatttcagatttgtagtacgtcacgaacaatttgaagctcgtcacgaaccaggatttgatgttgggttatcacgaaccgaagatttgaagccgcccgcctatgacttgagttcgcctttggaatttgaccacagacgacggttgcagatatggaagaccttgatgctattcctcagagcttctttagcctttccttctgcttacttgcttctgtcttagccctctcccttgacccctttatataggtgtgaggtggagtagtctccaagaaaaccctagtggatcattgggcttgaggcttatgggccgacttatttgatagaagactaatttgcgggctagcccaatagtacattggacgtttatttaaatcaatttaattggatttaaataataaacccaattataccagtccgtgttacttacttggaccaatatatatttaatttgtggtaaaatccaaatttttcatggatttaaatttgacaaaattttaattgtctacaatttgctctagacaaaaaaagtgaaaaaacaaaaaaaaaaaaatttaatccgacatgaattagaattaattactatacatttgaaatttgaaattattatagtcttaaagggaaaaataattaaagttaatttaatactaccataattaaaattacaattcttcaaggatttaaactaaaggataaacatatcataaaatcctcaacagatttgacttaaaatctctcttttatactcttccctttttgacttcggttactacacctatattatatatataaatctcttttttatactcctttaggccttttccgatttatatatataattttttttataactgaaatgttttcacaaaatgtttattatatataaaatgtgctcaatatatataaaatgtgcgaattttaaaaaaaagatttatatatataatataggtttttttttcagttttaaagaaaacaaaaatatttcattaaaaagatttttttctgttcttacaaaagaaaaaaatcaagtttttacaaaaaaaaaaaaaactgaaaaaactgaaaattaacggaggaatggcatatctgggccatttctttaacggtagtggcgtggatatagcaaaattttaacggatggcatagatgagccatttctgaaagttcagtggcatatttaggccttttccgattaatttataatctatggatatggtaataaaaagtaaaaaattaatatgaccggctatttatataagagatccaagagaatgtaaaactaacacattgtcaataacaagagatgtggtgttcgagtctaggtatatggagtcgcatttggtaggaagcgctttaattatcccttaataagagattattcactacgaattcaaatttagctggtccacaatacggatattgaaaccgagtgagaaaagaaacacaaattaattaatttcgatttccttcataacctaagccttcaaaattgaaaaggcaagaaaatattcttaaggaataattagaaaatgctgcttaactgacgcatttatattgtttggtagtttcttcgaaagtttttcgcgaactgagcactaatttttgacttggaatagtgtctgtaattctgactataactttttctagttatacaaataaagttcatctatgcattcaatcagttaaactttgcaatttctgtaatgtctattttaaaatcatgaaaaaattatttacacgttttgattagagaaacttaagagagttcataaactagtgtgtaccatttaatctgatataaacttctcagtttattgttaatgatatgctctcataatcacaaattataatgagatcatgaacaaaaagtctttttttcccttcttgtatgcgtgatggcaagtaggggtgtcaatggatattcgaaaaccgattaaaccgaccgaaccgtaccgtaccgaaccgatttttagatttatttttaagaaaccgtaggttttattataaatctataaccgtaccgataattagggtaggttttttattttataaaaataaaccgaaaaaataccgaaccgtaccgaataaattttatatgtagaaaatatatttatttggtatgtttaaaaataataatgcattaaattttctttgggccttggaattatgaaaacattacaagccaacaagtaattaaactcaaaatactaatttctaaaacctattatgctacatctacttaaactaagttatttcaagtatctttattagcaagacataaagtattctagcgattatgaatagcaaactataatatattgaatatgttttctttcatataatttagatatatctttttgaatattttatcttctatagactttattcttgagtcccatcttaatatatctttcaactcgtgtgatttatattttctttgcctttgtttgatttcttttacgttgttgtagaatagttgatggatctatactctagccatcttttttttaattcatcaccctttaaacagtaaaaatgtctagagagttttgctaaatcctataaaagaacgtatgttattgcattctacttctactggtgaattttacatgatatttaaaaaaataccgaaaattaaccgaaccgtaccgataccgaagagaaaccgacatgattgggacgatttcgaaaagtctaattttggttatacataatagaataaccgaaaaaatggtatggtataaattttataaaataaccatccgaaccgaaccattgacacccctaatggcaagtacatgcgacataaaaattacaaaaaattatatatcaatctctgttttaaaaggcagaattgggactcgcccgggactcgccccggggcggggctctcgtaaaacgcccctgggcttatgtatggggcttagttccgtgagacttacgcctcggccatcgggacttacgccccggacacgtccaacgcccagcgtactgggctcgcctaatagaactttatgcaattctatataactaaccttgtaaattatcaaatttgcttaataaatcattgactatttaaaattacttttttcttaatcataaatcattaagttgagagtattttatgtcatatttaaaataaaattattgcacgttatccactaagactactatgatagttaattttaaataaatctttcatttaaaaggtgtttatttataaacttttgttatgtctttactatataatagtcccataatttttataattatttttctaaatatttttttttacgtttacatgatacaatacttattaatttaatagctcagtattagctagtaactacttacaaataattagttatcatggtattgtatggtaaattatgtgtcactttattaacttattgaaacttaaaaataaatgatgctagaaaatcatatttaaattatgaattatgcttttatataaatcttctttcaaatagaaagcatattaaataaacggagtattttaagaaaaatatcaaattataatatcaaaattctttcaagattcattactcctaaagagatacatataatattttttattgaatacattacttttgatgtttgagtcgtaacgacgttgcagctaatttgcatattatgatatatgtcatacttttcgtattattcgtagttgaattatattttataaatatctcaaatagattattttttataattttgtgattttaatttaatttttatatttatttttttattttatactatcttaaaattcttgaaatcggtaaaatttaaagatccgtgggacttacgccccacgtctcaaggcttacgcctcgcctcgtcagaggtaaaacgcttcgcctcacgcccccgccttttaaaacattgatatcaatttgtcaaattcggttaataaatcgcgtttatgtgatgacccaaaaggtcatcacttgtttaaaataaaattctgcattctgaggccttaaaaacctctttcagcatcaccttgatttgcgtgcgcaatccaggcgcgtagtcggaaagcctaaatatgaaaatctgtgaaaaaatgataaaatttgactataaatgaattaatttgacttcggtcaacgttttgggtaaaggaccgggacccgaggaatatatgggacttggaagtatgctcggaatcaaattccgcggtcccaagcccgagaaatgaatttttaaagaaaattatttttctaaaattgtttaaaggatttagaaatgaaatttgattagaacatgttggtattggacccgtattttggttccggcgcccggtacatttcttatatgtgatttaagataattctgtgaagtttggaaagaaacagaatcaacttgacgtgattcggaccttaaatgcaaatttgatgtttaaagaagttttgagaaaatttcattgatttggagccccgagggctcgggtgagttttggataggccacggggtggatttttagacttagaaagttgcagattttagttggtgcagtctcctattcttctaggaggttagctgagatctatatctgggagattgtttgccttcatggtgtgcatcatttcggaccgaggtacgcagtttacctcacacttctggagggcagttcagcgagagttgggcaagcgggttgagttgagcacaacgtttcatcctcacacggacgggtagtccgagcgaaacatttaaattctggaggacatgctccgagcttgtgttattgactttggaggctcgtgggatcagtttttacctttagcagggtttgcctacaacaaccgctaccagttgagtattcagatggctccttatgaggtattatatggtaggcggtatcggtctccgattggatggtttgagcctggagaggctcggttattaggtacagatctggttcaggaggccttggtcaggatcattcaggataggcttcgtacagctcagtccaggcaaaaaagttataccgaccgcaaggttcgtgatttggcattcatggtcggtgaacatttttgcttcgagtgtcgcctatgaacgacctgatgagatttgggaagaatggcaagcttagccctaggttcattggcacatttgagattctcgattgagtgggagaggcggcttatagacttgcattgccgccgagctcagcagtcgtgcatccagtatttcatgtgtccatgctttggaaatatcacggcgatccatctcacgttttagattttagcactgtccagttggacaaggacttgtcttatgaggaggagccggtagctattctagaccgacaggttcgtcagttgagatcgaaaagttttccttctggtcgtgttcagtggagaggtcagcctgctgaggcatcgacctgggagtccgagtccgatatgcggagccgttatccccatcttttccccgactcaggtacttccttcttatgtccgttcgaggacgaacgattgctttataggtggagaatgtgatgacccaaaaggtcatcacttgtttcgaaatgaaattctgcgttttgaggctttaaaaacctcttttagcatcacctcaatttgcgtgcgtagtctgggcgcgtagccggaaagcctaaatgtgaaaatctgtgaaaaatgataaatttttactataaatgaattaatttgacttcggttaacgctttggggaaacggacccggacccatgatttgacggtcccagaaggtccgtaggaaaatatgggacttgggcgtatgcctggaatcgaattccgaggttccaagcccgagaaataaatttttaaagaaaattattttttgaattgattaaaggatttggaaatgaattttgattagaacatgtttgtatcgggctcgtattttggtttcggcgcccggtacaggtcttagttgcgatttaagataattctgtgaagttttgtaagaaacggaatcagtttgacgtgagtcgggccataaatgcaaatttgatgtttaaagaagttttgagaaaatttcattgatcttgaggtttagttcgatgttcatgatattattttggtgatttgagtacacgaataagtccgtgggatatttttgaggttgtgtgtgtgtttggtttggagccccaagggcttgggtgagttttggataggccacggggtggatttttagacttagaaagttgctgattttagatggtgtgcccaggcctgcaggcttcgcatttgtgaagcctggctcgcaaatgtgagctcgcaagtgcgaaggctggatcgcaaatgcgaaaccagcccaggggtgtcttgctcgcaaatgcgaggctctgatcgcaaatgcgattagtcctgttttagtcttgagtcaaaaatgcgactcccctctcgcaatttccaactcgcaaatgcgagggtccctttcgcaaatgtgaaagtccagctttcctgaagggttcgctaatgcgaaccgtgtttcgcattttcgaatttagtagaggtcgaggttcgcaattgcgaatccctgttcgcatttcccatacatgcgacctgcaacgttatacttagacgattttaacccatttttcatattctctcaaaacatacacacattaaggcgatttttcataggatttttcttctccaaatcaattgtaagtcatttttaactagttttcttcaatcattaacatcttttaacatgatttcaattcaaaatcaatgattttcatggggaaaattgggtgttttgggtagaacctaggttttaaaaaaatgggaatttagacctcgatttgaggtctgatttcaaaataaattatatatttgggttcgtgggggaatgggtagtcgggttttggttcgaacctcgggttttgactatgtggacccgggggcgatttttttactttttgggcaaaactttgggaaattcattttcatgcattcaaatcgattcatttagcgtttattgatgtaattaagtaacttgtgactagatacgagcgaattggtggtggaatcaaggggtaaagctaaagttgaatcgtgaattgtgttcatgacatcgaggtaagtgtttggtctaaccttagcttgagggattaggagttgtgtctatttgctatgtgttaattgtggagtacgatatgtgggcatggtgtcgagtatctatacgtcggtgtcaaacatgcatgtgagtcttgtgttataaattgttatgactccattgtggtttattgtgcctcacgttttattatcattattgttcccttgcagggatgtttggttgatagtattgttcccttgacgggatattgttgagatattattgttcccttgccggaatgtttgtttgatattattattcccttgccgggatgtttgtttgatattattgttcccttgccgggatattggtgagatatcattgttcccttgccgagatatttgtttgatattgttgtgcccttgccgggattccttgtgatattattggcttgtaactgggaatgggtggtatgcctaccacaagacataaagaaatgggagcgggtggtaagtctaccacaagacataatgaaatgggagcggatggcacgcctaccacaagacataatgaaatgggagcgggtggtacgcctaccacagacataatgaaatgggagcgggtggtacgcctaccacaagatataatgaaatggaagcaggtggtatgcctaccacaagataaatgaaatgggagcgggtggtgcgcctaccacaagataattgaaatgggagcgggtggcacgcctgccacgagatacatgaaataggagcgggtggcaccctgccacgagatacaggaaatgggatcgggttgcgcgcctgcaacaagatgtgaaaagaaagtaaaatctgcctttgacttcttactcttgttagtggttgggttttgattcctttttaattctcttgatattctgtttttacctgttattccccgaagcatgtctccccctcccatcgttacttgtttatttctgtatttctttcccgttgtatatatttgaactacacaggtttatttggtagtctggtcctagcctcgtcactaattcgccgaggtttggctagacacttaccagtacatgggttcggttatgctgatgctgcactctacactatatgtagattccggagcagcatttggtcagtagcacttggggagcctgccttcagtccagacagagatcccgaggtagtcctgcaggcgtccgcaggaccggcattctcttatactttattacatactctattttcatttgatttcgagacagattgtatatctttcagacatttgttgtagtaatcttagtccgtccatgatattgtgacaccggattccgggtagagacgtgtgttgtcatttgtagcactggtcttggttattatattagactaagtcttccgcatgattttatttatcgttataatttaatgttgatcacctgttaattcggattgataaaaaggggttaaaaatgaaagagttagtaatttctatgtttcgcggcttgcctagcttctacgagtaggcgctgtcacgacctccgagggtagaaaatccgggtcgtgacagtttatcaaatgcgatgtgtaagttcatttactaataaatgtgatttataagttgcgttgcattgaaaatcgtatttctccattgagacttacaccatcttgactagcacatgcattccatttataagattgaattgatgcacataattgttcccgaaaatattctgatagtattttctggatggttttgacgaatcgggcaggatatgagagggagttggaacaggttagacaaaacattagctatagggacacatgcaatcaaacactacattacaaaatgaaatgcaacatagtaacaaagaaataattgtaaaaagaaagaaataatatattcttagttaaacatagagatgacaattacatgcaaatgaaaacaaaacatacataattaagtactcagataataaaaacaaacatgacatgaccaaccatattcataagaaatgaatggagatttctgatacattcataatcctaataatatgtctgatacattcataatcctaataatatgtcggtaactaattgtgaagcttagcttcagttaatttatccaagtcatcatttcgtcctccaaatccagttccatgttcattagcagtagagacggatctaggatttgacgatagcatgaatcgtaatttcttttaatgtacaccttgtaataattaatatatagtttgttcgaaacgtgtttattctttagtttatttagacaatttagtagacattttttattgacaaatatgaaccttacatctcctactcagactctacttgtgggatttcactaggtacattattgttgtatgaaaattacgtcttagacatcaagaagcaaatgtaattagcattttgaagaaaaaatcacatctttattattaacagtagatgtaaaatcaatattttcactaggaaactacattttttcttcttttttttttatgctaaaaataaatttgcaccaataaaaaacatcttcaatgagagaactctacaaatcagaataagaaaaattaaaaaaaacaatatcttcaataaataagtaaagacagaattagataaatacggaacgacatcacccttcatgctttaactctcttccttactaagtataaatcaataaatgaaacaataaccggcacgacatcacccttcgtgcttaacactctcccgtaccatgtagcagaatatatgtaatatttgggaggaagaataagcaagaataaaccttacgccaacaactattccacgataccaaacctcaacttccaataatgttcaattatcacaaatagttcataaatgcggaaagacgatcaattaagcaataaagtagactaagcatggatatcataatcaaagaagggggaaaattataataaacaagtcttacccgcatgctttaacacaataacaacgcataagtacccgtcaccttacatatacgttgtacccgatattttaaagatatagcaaataggaaaacaagtccaaatcccccaaatcaaggttaaccacgatacttacctcacttcataaataattcagagctctaccgaggtctttcctctagaatccacctccaaactactcgtatctaaccacaatcgacgcgataacgtcaaacaatgctaatggaatcaattacaatgcataaagttagaatttttaaactttttccacaaggtattaaaaacaaccctaggcacgcttagtcagaacccgaggttcagaccaaaattcatttactcagtcacccctgagtccgattatgcgacctcgaatggaggtctaaatcccgaatttgcaaaaccctcaaattcttcccaaatccctagttttctactatggaagaacaactattagggctagaaattaatgggtgatgttagaaatggaagaaagtgagttaaagtatacaaacctgtgaattggtgttgagctttcccttcaaaattgcctctagtccaagctctaacggtgagtttatgaaaaatggaagaaatcccatttttggactgtcttaaatcattggcgctaggccttctgacgtgatcgcgaagcatagcagctcattggcctacgtattcgcaaatttcccttcacgttggcaaatgcatgcacccacccgcccctgcgtttgcgatcctagtgccacgttcgcgaagagtaactgttagcttcccctcccaagcccatgcccctaccattcgcgagaagctggtcgcgttcttaaagggtaaaacccccaacaatccgcatttgcgacccaactgtcgtgttcacgatgaagaaaatcctccattttcccaaacttacctttgcaattgcgagaaagacttcgcgattgcgaagcacgtgacaccagatacaatagaatctcaagaaatgagaaattttcaatgttcaaatggtccgtaggccatcctaaactcacccgatcgctcgggggctccaattcatgtatgcaaacgagtccaaaaaccttatatgaactcgctcgcatattcaaaatatcaaaaaaacgcctagaactacgaatcagacacaaaatcaaatgtaatttttaatgaaacttaaaaatttctattttaacaaccggacatccgaataacatcaaataacttccgttttgcatcaaatttggcatacaagtcattaatattgaaatggactaattccaagttatggaaccaaaattcggacctggtatcaatatagtcaaacatcgatcaaatttatgagttctttaaacttttaaacttcaaatttcaacaaattgcgataaatcaagctagggacctctgaatacgattttgagcatacgcccgagtcttaaatcacgatgcagacccactaggatagtccaaatacggatccgggtctgttttctcaaaacgttgaccaaagtcaactcaaatgaatttttaaggcacgaattcacattttaattaattttcacataaacgctttacggaaaaagacacggactgcgcatgtcacgacccaaatcgatggaccacggcaagcactcggtaccttactaaaccgagtaccgacataacataacctttcgtatcatgctattataggtaaatgagatggaaaggctgccgtaggataactagaataaacatgtaatactaacttatacataacacatatgggcctataagaccaaaatgatcacttgtatactaaacaaatgtgacgacctgacccgtcgtctcttgtatctccgtcccgttttccccgtgttatgcttcttcatgtgttattatatgtgttgggagagtttgaggtgtttcggattgaatttggatagaaatgagacaaatagtctctttaaggaaagcttaagttgaaaaagtcaaccggaagttgacttgtgagttagagggctcggaatggattttcgatggttcgagtagtttcggaggatgatttgtgacttaggagtgaaaacggaagtgaattcggaggtccggtgtgaaagttagcctattttggcgaagttggaatttcggagataaatccggttgataggtgagaatttgatccgagggtcggaatggaattccaaaagttgcattagctccgttaggtgattttggatatgtctgcaaattttcaggtcttttggaggtcgtttgggtagtttcggcatcagataaggttttgttaagtttaagttaacttagagttgaatttgttgattcttggtgatctttgatgtttaagttagcgtttttatgatccgagcaagtttgaataaagtattaggttgagtttgtgcctttggttgaggtcccggggacctcggggagattccggatgcttgtcggattggattttgggctttgtggtgttgcagaaatgcagtcagctgttgcagaggggttatctctatgcgatcgcgggggtcctatgcgatcagatacaaggaattatagggtctggccagtagagctatgcgaacgcgggatagctatgcgttcgcattgaggaaattgggaggcctggcagcaagcctatgcgaacgcaccttgcatgtgcgaacgcgttgaaggatttgaggcctggggtgaattgctctatgcgaacacactgaaggagtgcgaacgcatagaagggcggacctgggcagtgttttaatttaaggaatatttcatccgcgagctcattgtatttccaccatttttgaagaccttgagagctctttggtgcaaattgaagagggattcaaagaggattgatcggaggggagttttatgaattcaaaacatcatttaatcgtggttttagcccttaaatttctgaaatcaaatcaaattggggaagagctagggcttggaccttcaaatgaagattggggatttggaggagcaattagactccgattttgatgaactttatatgtacggactcgtggcgagacgaggattcctaaaatataagtttcataattttttgagaagcgggcccggggctcgggttttgctagtttcgagattttggctatttctcggttgttttcgattgggtattgtcccatttgcttattgtgatgtattcgctctgtttttgcttagattcgacgcgcgaggaggccgatttgagaggcaaaggcgtcgcaggcttgagatttcgccggttcgaggtgagtaatgctagtaaatgttgttctgagggtttgaaaccccggactttcacatcgtaacgctatattgaggcgtgactcgcactccaggctatgtgcggagtcggatgttgttggggattgtgacttggtccatcccgagtgagattctgtagtatactggcgtatgatacgcacactgtgatgattattattgggctatatgccgtgtttggggcctagtgccgacctgtgatatccttcgggagtcaatattactgattatcatgattgcatatcattttatatcagtccatggcttttaaaacattgttttcaaaacccaaccgtatttctaatgtttaaaactcacatgctatctttaaatgtatttcggctgaggatcatgacttataactgcccaagtggcttgtgatacattttctggactgattttgggtggtttgggctgcacgccgcagcggtgattggaaacagtggtaacatggacactgtgtcatacaagcggtcaggtaacatggactgacctggttttgattatatccacgagatggctgtccgccgtgggccctatgtgggtagatccggtgagacttattgattattcaccacgagatggctggttattgattttcgccaccacgagatggctggttattgcgcttgggctgtaggagcccctccggagtctgtatacacccccagtgagcgccgtcgacgataaatgatatgggtggctcggactgcacgccgcagtgggtactggattgtaccaacacatgcattgcatcgcatctctgcatctgcaccttatatatttattgttcagttgttctgttattgcagtactctgttagttagcttactttgtgcatttactgtgttttcttaccttcggagtttcatttattattattactcactgggtcggagtactcacattactccctgcaccttgtgtgcagatccagggcatactcgggcggattagatccagcagttctcaggcatcagcatttggagtgttgaggtagctgcacggcgttcgcagccatcgactctccctctatctttatttccagtattacttttgtattcccagttctaaacagttatgtatcagattgatctatatcttagaggctcagacttgtgacaccggttcctaggggggttttgttgatattcagtacttgtttcgtctgttttggtgcttaaatcttgtatattctgagtttatcatttctttcgcatcttttatctgagaatatgggtgttgtggtcgggcttgcctagcctcacggtcgggcgccatcgcgactgggatttgggtcgtgacaacttggtatcagagcctaggttactaggtctcacgagttatgagccggtttagtagagtcttgtggatcggtgcgtagacgaccatatcatatccacgagaggctacagaactttaggaaacacttcacattattggaattcttatcgtgcgtccttgattcagcttggaagagtaactcttgaaattccttcctcacgtttgtatgcgcccgtgagcgcccagtatcacatgtgccctgatggctgatgattcccctatcgaggggcgagttatgatttctatgagttgatgttgggccagtttggaggacttgaggccgaatttctgtctatggcttgagcacggggtgatgattttgcgagctagtattatgagctcctatgtccagtattgtccttaattgtggtaatggcggctgaatagcctcatgatgagtacgttggtgccgtgcgatgtattttttatgacttggtagtgtcgaaggaggtctgctagatgttaaatgaaccattaagtgttgactccattgtgatcgaaggtgttgccccgagttatgggcgcgagtaggatctcttcgagtctcctagctaggagtgtgtgtattgtggtatatgaccagactcaggaagaccaatttattgcgtgaggtgtatgacggtgaatgatataccaaaatattatattgaagcaagcaggtgggtatctcctgcagattattcttaaatggtatgatcattatgtggatgattgaatgtcctatgtggaattaaaaggtatttttctatatgttatgattcgaacaggtgcaacgcatgttcatgtgtcaattttgataaaataatgcctgtagtattgagatttatattgttgatatacattgtgatgtcttgtcaagttgtggacgtgttgttaggatggtttggtgattctctgacaggtggataggctcaattacaaaggaaactctgccgaaatttttggaaaatttgggacttagtagaaatttcgtcgcctaaagggtgggcttaacggtcgtgtgaatgaatgcaaaaagttgaagaaaggttggaatttatgatgattcgtgtttccacaagcttatggatgagtgagtttaatcttgccatgatgttatgatggctatagagtatgtgtgttttaacatatatggcttcaagctaagttggggaggttgctgttgaatagctgatggtacggttatgtactgtattagttccgatttgatgcatgtgtgtgaaccagtgctagctgcagaaagtgagccgagggtggcacaagtgaagcaaaatgttgccaaggattatgtggtacttcgtgggtgtgagaaaataagggaatgtcttgagttattgatagagagaatgcttagcataaggaaaaggaagttgttcggttgtatcggaatgagatcatgtcctgtggtgtcagagtgtcgataaggcacgaggggttcgattcgttaagtcaagtaatttgcagtaggcataagagtgggtgacttttgagaagggtttcgatgcgttcaagaatctatatgtatcacccaggtgttctaaggttgagtatgcgacctagtcagtgctttcattggaacaggtcaagacttatggtatttttatgttaattgcgagattctaagtatcggtattcgggatgaattggcaattaaatcagagtcgcaagaagttctttgggtaaagtattctggaatgtggtagttccgagaacgtttgagaaagtatccagtggcctaagggtcttagacagtgtggggtggtgttcgggtcttgtatagtgagcctgggttgaggcattgtggtgctacggcaagagggtgtatcaagttgaaaaggaaccaggtgggaatctaggtaaataaagtaactatttagtggaccgaatcggtatggtaaggatatgattggttctcgttgtgtatttggggtaatggtttagcacgggaaatttttgcagcaatgctcttgggtgttgacgattctctctgtgtgtcgtaattcaaaaggattcagtcacggcggtttagttgtgcagatgggattgggagagttcttgttaattgatacatggttgaagaggtgcatttctacgaatgtgagatggcatgagatgtataataatgttcttctgtacgagatcaatgaaagttccagactagttgagagcgttgatgtctgcggcgcagaagggagacgaaagttctcgtgttatccttggaggatgttgcgtatgcggtatgctgtaaagggctgagatgggcatgtgcgagttctcgactcagttctgaaaggtatggtggatttggctatgtcttaggtaatgagttgcttcaggtaatcaaggaattggtactgttaattggaagtgatttgacgatggcatatgtctcggaaagagggtaatctcacaaatgatacatcgatagtgttacgacatatccttatgggatcgactgcagagatctgagttgtttgatggcacgcgggagttttaaaatatctctcgcgggatagttgggtacttgaggtgtgatccgtatttcgcattgtggaaatttggatcaaattcggtgattcgtgttctatgagtggtcggagactgggagtcctccggtgcagtctatgcgataattgtgttgtattagtactgtaagtggctattgggaattcgaaagccgagtggatcttcccttgcttagtatgttaattccggacatgttatggggatacagagtgactgcctcagtgtcggattgttctacgattgtgctatgaatcatgttgggaattgccacaggttgcgtggcggggtgtatcagtctatgttctagctgtatggttgtgtttcagggaccagtggtcggctgggaagaattgcgttccttaattgggccttcgaggcggatgttagtatagaggtttccaccattgatttggttccggtattgagggactttttggatgcgtccttgtggccgggcatgtcaccgggcgagactgtgaatttcggtaattatttggtgccgggcaccatatcgtacggcttcgtcatgagttatagtagtgaaagtgggatcttgtatgttgcaatgcttttatgaatatctttaagcactcagttgcttcgaccgatgtgggtatttagtattatgagcagatttggctcgctgtgcacctccttatgtgaggtatgttgtgtggagcgggtggcacgccgccacgggtatgttatcgggatcgggtggcacgccgccacgatgtgatgtgagaatagctttccatgtgatgatttgtattctttgcatcctggcttccgagggaagtctgttttgaaattgctggcaaatagcgtatcggttgtgtcccttcaggactgaatgatgtatattacttatttcaccgtgagtgtgatgggttacttgattttaggcattgatatgtgcatggttgtcggctttgagcatggtagcacgaggtgattcatgtgtatcagtgttgggataggatcgcgtgttgtgacgaggccacgtgaagttatgacctctcgaggaggattcaggtactctatttcctatgatgtgagacgaggtctcagctttgttttgtaaatgtattgatgagcttgatgtataactctgttccggttgagtcatttgccctgatttgggtatgtgtagactgttccttattggcgcgtgttgtatgcaattgtggcttaggcctgtattgaggtatcatatcatcagaagtggtgtgttagattcgaggtgatcattggggtcattaatgaatatgaacataattgatttcagcaggttagaaggataatatcgaggtttgtggtgatagtcaacatggaagtgacttcaggagtggttgatctgaagagctgctacggtccattgcgtgtttcagttatcattggcagcatacgaaagtgttggaataggactctagctgaataagaggtgatctgttggtattgagtattgtgggcaactatggtgaatagagactatcgttccgagtgttggagtgtgtggtatattgtgtggattcgcctgaggatgcaggtgtgggctattacagctggtttgggttaattctgagtatagatgtgaggttctaatcttgtgtacgatttcggaaagtgcaacgtgattctgcggtttatgggccagatggattgtggaaatttcagttgtgatgtattttcggtacctatgtgagttagggtgacgtgggatcatcccgggtatatgcctggtaatgtcatttggctattggattgcttctagtacagctctgggtacgctcgaggacgagcgtttgtttaagttggggaggatgtgacgacccgacccgtcgtctcttatatctccgtcccgttttccccgtgttatgcttcttcatgtgttattatatgtgttgggagagtttgaggtgtttcaggttgaatttggatagaaatgagacaaatagtctctttaaggaaagcttaagttgaaaaagtcaatcggacgttgacttgtgagttagagggctcggaatggatttccgatggttcgagtagtttcggaggatgatttgtgacttaggagtgaaaacgaaagtgaattcggaggtccggtgtgaaagttagcatattttggcgaagttggaatttcggagaaaaatctggttgataggtgagaatttgatccgagggtcggaatggaattccgaaagttgcattagctccgttaggtgattttggatatgtctgcaaattttcaggccttttggaggtcgtttgggtagtttcggcatcagataaggttttgttaagtttaagttaacttagagttgaatttgttgattcttggtgatctttgatgtttaagttagcgtttttatgatccgagcaagtttgaataaagtattaggttgagtttgtgcctttggttgaggtcccggggacctcggggtgattccggatgcttgtcggattggattttgggctttgtggtgttgcagaaatgcagtcagctgttgcagaggggttatctctatgcgatcgcgggggtcctatgcgatcgcatacaaggaattatggggtctggccagtagagctatgcgaacgcgggatggctatgcgttcgcattgaggaaattgggaggcctggcagcaagcctatgcgaacgcaccttgcatgtgcgaacgcaccttgcatgtgcgaacgcgttgaaggatttgaggcctggggtgaattgctctatgcgaacgcactgaaggagtgcgaacgcatagaagggcggacctgggcagtgttttaatttaaggaatatttcatccgcgagctcattgtatttccaccatttttgaagaccttgagagctctttggtgcaaattgaagagggattcgaagaggattgatcggaggggagttttatgaattcaaaacatcatttaatcatggttttagcccttaaatttctgaaatcaaagcaaattggggaagagctagggcttggaacttcaaatgatgattggggatttggaggagcaattggactccgattttgatgaactttatatgtacggactcgtggcgagacgaggattccgaaaatataagtttcgtaatttttgagaagcggacccggggctcgggttttgctagtttcgagattttggctatttctcggttgttttcgattgggtattgtcccatttgcttattgtgatgtattcgctctgtttttgcttagattcgacgcgcgaggaggccgatttgagaggcaaaggcgccgtgggcttgagatttcgccggttcgaggtgagtaatgctagtaaatgttgttctgagggtttgaaaccccggactttcacatcgtaacgctatattgaggcgtgactcgcactccaggatatgtgcggagttggatgttgttggggattgtgacttggtccatcccgagtgagattctatagtatactggcgtatgatacgcacaccgtgatgattattattgggctatatgccgtgtttgggggcctagtgccgacctgtgatatccttcgggagtcaatattactgattatcatgattgcatatcattttatatcagtccatggcttttaaaacattgtttttaaaacccagccgtatttctaatgtttaaaactcacatgctatctttaaatgtatttcggctgaggatcatgacttataactgcccaagtggcttgtgatatattttctggactgattttgggtggctcgggctgcacgccgtagcggtgattggaaacagtggtaacatggacactgtgtcatacgagcggtcaggtaacatggactgacctgattttgattatatccacgagatggctgtcctctgtgggccctatgtgggtagatccggtgagacttattgattattcgccacgagatggctggttattgattttcgccaccacgagatggctggttattgcgcttgggctgtaggagcccctccggagtctgtatacacccccagtgagcgccgtcgacgataaatgatatgggtggctcggactgcacgccgcagtgggtactggattgtaccaacacatgcattgcatcgcatctctgcatctgcaccttatatatttactgttcagttgttctgttattgcggtactctgtttgttagcttactttgtgcatttactgtgttttcttaccttcggagtttcatttattattattactcactgggtcggagtactcacattactccctgcaccttgtgtgcagatccagggtatactcgggcggattagatccagcagttctcaggcatcagcatttggagtgttgaggtagctgcacggcgttcgcagccatcgactctccctctatctttattttcagtattacttttgtattcccagttctaaacagttatgtatcagattgatctatatcttagaggctcagacttgtgacaccggttcctaggggggttttgttgatattcagtacttgttccgtctgttttggtgcttaaattttgtatattctgagtttatcgtttctttcgcatcttttatctgagaatatgggtgttgtggtcgggcttgcctagcctcatagccgagcgccatcgcgactgggatttgggtcgtgacaacaaaggccgacaaggccatacaattttcacgtacatgacatctgtctacaagtctctaagaatacataatatcataaaggccaggatagggtctcgccattccaatcaatacatgtactaataatattgacccaagaagcaactccggagcaaatggagtgtgccgacaccttccgctgagccgatagcctacttggatggctcccatcctgtttatcgggacctatgggcatgaaacgaagcgttcccaagcaaaagggacatcagtacgaataatgtaccgagtatgtaaggttcataaataagtatataaaagacattgaagaaacaaggagtaaatgactcaacctgtaagtctggataactctgtaaatcatgaaatacttatagagtcatgaatatgcgtatgaatgtcatgtcgtgcataggtacaggtattcataacttcatcaagcctctgagggtatcccatcatatcatctcagccactatggcaaaatcatcaatgtataccagctgatcaggtggtggtgcttatataacgccataacatttcccataaacatatatatacgcgtatataactccatctggtcatgggtcattgtgcatgtatgaatgcatgaaatacatatgaatacgttaataaaatctccgggtacgtcataaggccattatgcctctgattaatatcatgaaataaactttaccaacttacatattactgagacccatgaacatataatagaataatatggcacatgggagaatcaaaatatacacatctctagtatttctacgaatagagtaatttatgaaagttgtgcattttgctcgtttcgcttgtgtataactctgatcatgccaaaaagaaataagggatagtcttaacatatttgagccggttctctggacaacgcttctagcaaactataactgtgacaaacttcatgatgaaaatccgatccttttttttttgggggggggggggggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggggggggggaggctaaatgtgcaatagcacttaaggaaaaattcagtgaacaagaaagcctcaaatgaatagcaagaactcatgctaacaatttgttaagtagcttaaacgaaaatgaatgaccataaacaaataaccatgaagtttaaactgtaaggaacaaccaaattcatgaaccaaaaaaaatctaacactattcctttggtcatttggtaaacggaaaagggtcaaaaatgccattgaactttcagaaatggctcatctatgccatccgttaaaagtttgctctatccatgccactgccgttaaagaaatggcccggatatgccattcctccgttaattttcagtttttttagttttttttgtaaaaacttgatttttttttttttgtaaaaacagaaaaaaactttttaatgaaatatttttgttttctttaaaactgaaaaaacctatattatatatataaatctcttttttaaaattagcacattttgtatatattgagcacattttatatataataaatattctgcaaattttggacaccccacttcatatttctgtgtgaattagctatttttgctatacgggtatgtatattttctcttttaatcaaactggacaagtttaaatttattgctcagcacctctctggtaaatttaacttgtcatttgtcatctgtagattcttgatttttttttctcattctatatatattatatatataaatcggaaaaggcctaaattaactttaattattttttcctttaagactatattaatttcaaatttcaaatgtactagtaattaattctaattcatgtcagattaattttttttttgttttttcactttttttgtccagagcaaatcttttcagttttataaagaaaaaatatttttatttttttaaaatctctcttttatactcttccctttttgacttcggttactacacctatattatatatataaatctcttttttatactcctttaggccttttccgatttatatatataatattttttttaaaactaaaatatttttacaaaatgtttattatatataaaatgtgctcaatatatataaaatgtgctaattttaaaaaagagatttatatatataatataggttttttttccagttttaaagaaaataaaaatatttcattaaaaagattttttctgtttttacaaaaaaaaaatcaagtttttacaaaaaaaaaaactgaaaaaactgaaaattaacggaggaatggcatacctgggccatttctttaacggcagtggcatagatagagcaaacttttaacggatggcatagatgagccatttctgaaagtttaatggcatttttgaccctttttcgtttggtaaatccttagaagactaaataatattataaagggaataaatccttcgaaggctaaagaatattataaggagaatgtaatccttgtatgtactttaataatgtgacacctttctccatattatatgagtcacttaggtggctttatttaccatttcatggtcttccacgtggggcatttgtccccgcttattaattatctacaaatccttaattacatggttaatctctcactaaatcaagaattaatcaattactcacataattaaaaattatctcaaattacttagaatactactcccttttaacacaccttatacaccttactatcatggttatgtggtaccttgtaaggtattagtccataaataccaggtattttaactcgggccacattttatcccagaatgtcaaacttcgaagaaattcatttttttccgatttgcttaccctctcaccttcacgaatttactcatcacttttttgaaatagcataatgcttataatctcaaaatattcgcattcccgaacttacgttgattaacttacgacgaaacgttaacatacaaaaatgcaggatgtaatatctcatttccgaacctccatcaatttatttatggcgtactttaacgtatgaaaatatgaggtgtaacatcatccccccttggaacattcgtcctcgtttgactgatgcacttatcatttttatggcttatgccttccaaatatttttgtcacggccctaaaccggaccctgtcgtgatggtgcctatcgtgaaacaaagccagccgacacaaatccccaaacaaattaacagttataataattcataattaagtcattaataagtgataatgtcacgacccaaaatccacaaagggtcgtggtggggccggacacagctgtcaggcaagccaatcaaattacttaaacaaaatctcattttaacactttaaaaatctaggattcttcctctatatttaggaaattttaaagaatagttttcaaatcaaatttaaaagttaaacaattaatacaatacttcaaaccctcccagaacccggagtcacaagtgcatgagcatctactgaataaagaaataatatacaatatccgtccgaaatacagtggacgaaagtaaatacaatacactggaagggactaccctagctgcggctgtctcgaatgatgcagctcatctagtcccaaaatcatccgtgctgctctgccagtagaccactggagccacatatacctgtgcaataaaatgcacagcaagtgtagtatgagtacaaagtttacccaatgagtatcccgcctaattccgaaggggtagagacgagatggtcaacttcgacactcactagtagtccaatgactatttatcattttataaatatattcaacggtgattttattttgtaacatgtttcaaatccaaatagaggaaacaagtaaacatataattctttcatggaaaatttccttagatttcttattatttttaacaatatgatctcgccataatgaggcataaaaacaactcaaataagttcaggcaagcaataccagcatgcgcaaatcacaccgaggggacggcccgatccaacggaaatataaattgtgcactgccgagggtcgaacggctcgaaccaatagatgcatctattttccccgctcgtgaatcatccatgcgacacggtaaatataaagtaaacaaataacctgctcgcgaatcatccatgcgacgcagtcaacaaataccctgctcgcgaattatccatgcgacacaggtacacacaggaatacatgctcaaacagtcaattaagaattttcgggaacaattatcaatttacaagcaattcccttttttttattcaatttaaaaaatagaagtgaaatcctttaggaattcgtttacaaattctatgtgatttaagcaattcaagccatcaatggcttcacaattaatctaagtataatatgcttttgggtcctaaactacccagacaatagcataatagtagctgcgcacagactctcgtcacatcgtgcgtacgtagcccccacaaattggagcacataatcaatttaaatcacctatgaggtggttttcccctcacaggattaggaaggagactcacctcgctccgaagattcataaccggcattctacattcttttgaagacctgaaccaacgcacaaatgctccaaaactagtcaaacaacgtcaaactaatgagaatatactcaaatactcgctaacaattcaaactatataatttcccaactccactttgtgaaatgaccaaaatgctctcgggcccacgtgcccggattctaaaatttgttgaaaataaatattacccataactcatatggtgtatatccataaaatcatccaatttcgtccatgaatcggccctcaaatcaaggatttaccatttttcaactttggggctcaaaatcctaatttctaccatccaaacacggataaaaatagaaaccaacagaaataatcatggagaaacataaaaataaaggtcagatatttatccccttgttgagacgagaacaacgccgcgaaaatcacctcaatcagagctttagaactcaagatatgcccaaaatactaaaattctcggtttatacactgtccaggcccatttttcgcttatgcggaccattttcgcctaagcgggaccgcttttgcgatcctttttccgcttttgcggttccgcatccgcgatcaatgtccgcttatgcggttctgacagaaccagatttttttctcgatacggaaacgagcataacttcctcatacgatgtccaaattcgacgattctttttcctatggctccaaaatttcgatacggatctaatggttcaaacaaaactgaatttggagctcatttacttaatatggtaccctttatgcccaaagatacggcgttgaaatgtcaaataagagcgtgatcacaacccgaaacacacccgaggcccccgggaccccaaccaatcataccaaccagtcccaaaacacattacggacttgctcgagacctcaaatcacatcaaacaatgctaaaaccatgaactacacctcaattcaagcttgaagaactttgaagttttcaagttctatttccgatgttgaaacctattaaatcacgtccgattgacttcaaattttacacacgagtccaaaatgacataacaaagctacataaattctcggaattccattccgagcctcggatcaaaatctcacctatcaaccggaattcgccaaaatactaactttgccaattcaagcttaattctacaccggtcatcacaaaaatattccggacatactcctaagtcccaaatcacctaacgaagctatccgaaccataaaatttgcatttcgagcccgatatcaaaatttccacttccggtcgaattttctcaaaaaccatcaaatttctatcttttagccaaacggctccaaaatgacctacgaacctccgaattcacttccgatcgcgctcccaaatccagaatcaccatacggagctactcccaatctcggaatcccaaacggacatcaataacactaaaatgcattttaagccaaactgatgcaatttcttctaaaatgctatcttccacaataggcgccaaaatgctcccgggttatccaaaacccgatccggacatacgcccaagtctgaaatcatcatacgaacctgctggaaccatcggatcccaattccgaggtcgtttactcaaaattccaatcttagccattttctccaacttaaggcttctgaaatgagaattttcatttaaatttgactccaaacttcctgaattttaattctgaccatacacacaagtcaacatacctgagatgaagctgctcatggcctcaaactgctgaatgacgcgccggagctcaaaacaaccggtcaggtcgttacagataaatcccaaaatatagtgaaataaaataaatgcgaaaacaaacatagcccgacatcgaggtgtaactagtcatgaccatctaaacaaccatctcagtgtatgaaaaaggactacacagtctattacaatctagcacaaggaaagtaaagataggaaggagaaacactgggttgcgaacaccaagcatctacctagtgaactccgaacagcctgctggaagcaatctacccttgctaacgtaacccgagactcctgaatctacacacagggtgcagggagtaatgtgagtacgccaactcagtgagtaataaaagtaaaggcatctgagtgataagaaaatacgtaaaacacagtaagatgctacaaagaggcggtataaaaccaatacaatgcaataaaatagtgaaaacttgtaaaaacaccttagttcagcaaaaacctctttaaaacatcttttaatagttcaaacgagtgaatgaaaatagggagatgagatagattcataaaccagcccctcaggcaaaatgtcaacagaatcagcccctcaggcaataacatggaataacatcagcccttcgggctatatcacatatcacactgggtacctgcgctcactggggtgtacagactccgggagggtccccttacggcccaagcacaatgtcaagccatctcggggcataatcaaattggttctcggcctcatatcaagccatcccgtggcgtacaactcaggccctcggcctaaaatcatcaatcaacacaatatcgctgcggcgagcagcctgatcccataataacctcacaacacaggccctcggccctacttagtcagaaatctctaaaagccactcaagcacagtaaaatgtgatgctcagcccaaaatatcatttaagatgtcaaaatagagtaaacatggctgaggtatgaaaactgtagaatatagcattatttagtacaattataaagtcaaaatagtgagaaacagaagtaaaaatctcttaagggtccaaaaaagttggcacgaggcccaaatatggcattcagcccaaaacatgatgatagcaaatagttttcaatcaaatacgcagttaaatagtcatacgggaaggactaagtcacaatccccaatggtgcacgaccccacgctcgtcatttagcgtgtgcgtcaccacaaaatagcacaacgatgtgaaattcggggtttcataccctcaggatatcatttacaatcattaattacctctatccggtccaaactctagcccgcgatgcctttgcccctcgaatcggcctctggatgctccaaatctaaccaaaatcagtacataaccatcaaaatatgctaatggaataaagtccactcgaaagtaatcaaattacaacacaaatcccaaaattaaccaaacccaacccccggccccacgtttcggaatttgataaaaattacatcaataaaatccttgtcttcccacaagctcatacatatcaaatacatcaaaatccgaccgcaaatgacccctcaaatccctagatttagatctccaattcccaagccataacttccaatttttaggcttaaatttcacaaaatccatgattaattaggtagaaattatattaggattgagtattaaattcataaatcttacctccaagtgtttccccttgtttccctcttcaatcttcctcaaaaagctctaaaatcgcccaacaatggtgaaacttagactaaaaatcgcggatatggccttttaaaacattctgcccagctattcaaaatccttcttcgcgaacgcggtcaaagcctcgtgttcgcgaagcacaaactaaagttgaccattttctattcattgcgaatgcaacccatgcatgcgaacgcgaagccttagcttcacagcacatcgcgaacacggctacccactcacgaacgcaaagaataaattgacctggacacagctgctcaccgttcctctatgcgaacgcgactaacccatcgcgaatgcgatgaccatatatctcaaaccttcgggatagggggaccaccttcgctaacgcgaaggcaaacttcacagcctcacctcccaacccttcgtgaacgcgaaggtcaaaaaccttcaacactaacagtagtttttctgcaatttccttcaacatgaaatgatccatttaaccacccaaaacttacccgaggctctcgggacctcaaccaaacatgccaacatatcccataacatcattcaaacttgttccaaccttcgaaacactcaaaataacatcaaaacaccaaatttgcatctgattcaagcctaaaattctaaaaactttcaacttccgctttcgatcaaaatgtcaatcgaaccacgtccgaatgacctgaaattttgcacacttcaaaaatgacaccacggatctactccaacttccaaaattttattccgacccctatatcaaaagtcttatcaaccggaaaatgccaaaattctaatttcaccaattcaagccaaaatccactccggacgtctaaaacacattccgatcacgctcctcagttccaaatcaccatccgaagctatccgaaccatcaaaactcatatccgagccctttatcacataagtcaacatccgattgacttttccaacttaagcttactcaaaagagactaatagcccgtttggccaagctgcaaaaatcagcttattttgagaagtgcttttttcccaaagtgcttttctcaaaagtacttttggtgagaagcagtttgtgtttggctaattagtttgaaaagcacttctgagcagcaactagtgtttggccaagctttaaaaaactgcttctaagtgtatttttctcaaaagtgcttctcaaaaaagtgcttttggagagaagctacttttttctgcttctctaaaactgcttctgcttctcctcaaaagcactttttttcctcccaaaagcttggccaaacacctcaagttttggccaaaagtgcttttggccaaaaaaaagcacttttggccaaaaagaagcttggccaaacaggctataagtgtcttaaaccttacaaaaacctctccgaaccggagccaactaacccgataacacataatacagttgaacaaaataataagaagcagaaatggaaaaaaagagtggtaactcacgaaacgatcgactggtcattacaattttagtactctctttgccatctaggcaactgttctgtgaattattccaaaagtcagggcatttcccccctttagtcctctttctcacaccatgacttatggtcagaattcttccaatcttgtaactgttgctaccttctgtcatgcagcttgtactacgtcttcctattatatgtgcctatgcgactcttctctcctctttcctccagcttttagccaatctctaggcctcattttgtgaacatatactaatttatgtaaagctatcccgttgggcgtcattagctttaccacatctaagtagtccatactataccatagttcatacttcgatttatcattattgaggtctgctaccaactccagtttactcttattgcttatccttaagactgttggcctaatctcgtctcatacttcgtaacttttatccatcccttgttggttcgcctcaatattgatctacgatctatcactgataacttgagcacttatgtaacatgaccgctagggctcacttcttattggggaacatctgaaatgattagacgtactgatccaccttggagcgataccatatttccataactgtattacatagtatcacaatatgattcacattacgtgggtatttcatagtatctaaaactagttcatagtccaaaaaacacaaaatttaatgcattatgctaatttatgaaaacccagcaaaaaaatttatttcactatatttttaatactctttttgagatatgtgggggattggtaaaatttttttttataaactttcccataggcactggtatgtttttgtggcttattaatatcttgtaattgtgatatagcgttatttaattaatatttaaaatgtttcacatgctattgggcatcatcgcctctaccagttgggacaggagatgcagcagcgtgccgatatccctgaagtggttgagtatggccggcaggtggcacaatggctcgtctgacactgttgcaggcgagagatgccgagaggtatgaccacgaggctcagtatgcggctccagaagcctaccatcggggtagggcagtcccacgaggtaggggtagggcatgagggaggggcgccccacggggtcgcgggggacggcgaggaggtggtcagcaagggggcgttgaggtgcctgtcgacccacctgttgagggacatgacgaggactttggaattgagggacttggagatgatcaacagggttatatgcctcatgcagatgagccttccaatagcatgccttcgtatagccttcagctatctttgccaacatcgcaggtcaccccgccaggagcattgtcgatcacgggtacattcgacggggatgtagatcagtacttcgcatgcccatctaccgcagttgaggatcggccgacccgagacgtggatggcgggcacaggttgagttatccctcatccccggcggttcatgcggatctaccacaggcggcggtatgtttgtattactttaaaattttaatttgttttcttttccttaatgagccaacaataattaatttttactttcttatgaagtcttcatcacaacccatctttgaggccactacattagtaattcgcagtactatactgcgaattgccttaataaaataaggctaggcccaactcataaatgaaacgctgcgtttaagcaattcgcagtactatactgtgaattagattttaaaaaaaaaattataaaatagttcgcagtactatactgcgaattgctttaacggcaaaattttcgttaaactaattcgcagtacagtactgcgaagtacctattttaataacttttttttaagcactaaaaatgtgctttgtgtctaaatactcattgtcgacgccccccttttcccctaaagaaagcgaaatcgagtttacgacattatggacaaaacaactcttattccttttgaggaatcgggttatggaatttgaagagtcgccacctaatgattatagtgcgttaggacactttaaagaaaagaagaagactttggaagaaaaacaagagttcgggtaagggcttgagattatctcgaggggaaggaggcacccctcaagatccactagtgtggttcccggacgtactttaattgtgactttaagaagagtagaaggaaaacaaataaggtttgcacatagtggctacaaataaacttgaaagtcttagaaagatgaaaggacataaatgatttttttttttaaaagagaaggagtaactggaagaaaacataaatttaagaaaagcattatacaaataaagaaaaaggaaaggggtcctaggtttaaatttaatatggatcacctcagtgcaataccccgcacacactcctcagaagaggggtcgcctatgatattagcgcaccggtcatcatcttcatattctaccctccccaccccgttaaggtattaaacgtgattagtctcgtttacttattgcatgctagtacccgtcccaacctatcagtcccggggtttttaggacttctaatcctgaggggaaaggaaagggagtatgggcatatgtggagtttcaaaaaggatgaaatactatggcgacaatcaaaacaaacagcaagtaatgaggaataaacaaacacacaaaggctcacataaaaccccgtaagtcacatagcatttagtttagcatgccttgcatatactgatttggtctttaaattgaaataaaatggcggacggactagtttaacacatagagttagataaaaagtctgcattaggcaacccagatccaactatcagaaattgaggtatttttagccagattatttagaaagcactgatttcaagcaagcgcctaaggcagaagagtttaaaaacagaagattgaaaatttgcagaagttcagagatgactttgaaatcagcagagttgtttaagtgaaatacggtagagttgtgcaaaagagtttagaaagtgaaaagactttaaaagtaagaataagttaaagactgtttcgaaatagcagcttcatgagatgaataaaaattcaggcagaaggtttaaaggcgttgttttacaagtctgaaaggaattaagaacattgcagatttataagagttttttgaaaacgaacaggtttggacgagttgtgctgaaaactctgcaagcagttgacaaattattatcaattaaactcattaggcgagtttgaactcctataggcataatatctatgtcttgatttttaggacttgttactgttattaaaccggtacgaagtgagtatttgattaccctacagtttgcctagcgtttatgcatttcctataggcatgatttctatatgcaactagttgtttgattattaggtcctataggcaagatctctactgattttgcagtatgactgaacattaaatcttatagacatgatttctaaataattgagttaagaaaatgttaaaagccaatagacatgatctctaggtgatttaaagcattgaacatataggcatgatatctaagcgattgaacaacattggtcctataggcatggtatctaccctttagcatatgcaagtaaatatacacccatcacataccctgtactaatatttccccgagttctttttacaagattattatagaaccagaagaaataaagccaatagcaaaaatacatcacagcctacagctagatccgagcatcctaattcaatcttgatatccaataacatgtgtttcaccaaatccggattccagattccaaagccttctcttattcaaagtgttctagagctccaaggagcctcgagagccccaggcaatgcttacactctgaataacaattgtagtgacagaatagtgcagtgtgaaattaccagccctcatggcatccaagttcagagggaactccaaggtcccaaagcatggcttgccaaagggggcagaacttaaaaactagaaataagtgcaaagtgagagagggaaccatagcagagggtggtcatacccagccatggcataggctggcacacccctgaccctctgcttaggtacaaataattaggagcagactttagaagtcagacctgggtctggatggtgattaggacaccaccagaccaaagtcgaggctcaacgcataaaggatggagggggtgggaactgatttgagtagaggctccagagaacctgattctaagtcatgagtggcaataatagaatgccagcatgactcagaattgcactcacacataagaggggtcaaggggaagggatttacatagaaaagcatacacagaacctttaaggaaagctaagaaagcataacagactgaaggtgcaaagacatagaagaaagagcataacagactatgatatagttacatagttcaagaaagcataaaataaacacatagtgaaggatgtgtagaagaggagaagtaaacacatagttggagggtattatttaaactagaaggacataccagttgcaatcttagtacaacaaagcaagtaagagcaagtaaacaaccagagagtcagcaggagcaaacttagaaacctcaggaactcaagaatgtttccacagtaggtagtaaaggagcaaggtgctcagtaaagaaaacaatagtagaggaagtggtagtagagagagtagtagtagagaaagtagtattagagagggtagtagcagtatatttcaaagacagaggtgtctgtgtatcgaatgtgtgtgttgtgtcaagagaggagcatgtatttatacttgaagtcaggcaggtaagcaggaaagaaaatagtccagtatcaattaggatcaatcaattaacagaggttcctttaattaaggaatcccaatttgaacagtaaaggacatgagataattaaggaaaggggatcaaatatacaacattgcatagtatacaaataagggtaaatacataaaagttatttaaggacaaggttttttttgaaatacacggtttgtgcaaataaggtaagaagaccaattaacaaccagtaaataaaaggtcagggattttgtatgaatgaatcaagtccgaaagaagggagaagggttttacttaggtcgagtcacgggcaaatggaaagaaatcaatcaggctatatacagaagaaagtttgaactaattgaaaatttgaaaaaccattcagagggaaattcatagtatataaggagcatacgaacatgttaagcatgaaagaagactgtagtgtcattgtaaacaatcagtaggaaaatccagtgtagaagagttttggcaaaaggtaagaaccatatgaaaacagagacgaattcagaaattagggcattgaaatcaaattagttcagagatgagaacaagcaagtcacatacaagtggtctgaaaacccccaaattctagggttttcgtcattaatccagtgtagagacgaaagcaaataaatcaggcaagagtaaattcaaaaaacccaaaggaacttatacgttccatgaaaatattaatgagagaaaacacagtaaaagaaaattcaaggaaacgttaggaggaaacatagtagaagaaaacacataggagtcacagtagggcaaacacagtaataataacacataaaaatcacagtagaataagtaaagtcaaggaaaccctaagtcggagaagaggaacagttttgaaagcagagttttgaaagaggcttaagaaatcatttgaaaatcttaaaataaatacggatctagagcagatctagagaaaaataggaaaacctcgaaaggctagggtttcagaagaaccctagtagcgagaaaggcctggaaaagggtctgttccgagtcgaatgagccagagatgaactcatagggctaggatatgccggattcaagccggagattgccgcaaaactcgaatcggcagagatttaagcaaaggtcttcaaggtcaggccttgaatcatcaagtaacaggggtataagggtacatgggggtgagtacaggccacccaggacttggaaggccattgattccggtgaaataaggtggaaaccggcggggtagagctagggtttcggagaggattagagagagtttgagagacgaagggattttagggcagccgtttttgagaaatgaattagggttaggggtgatttggaattaaaaaggaaagaaaggttgtgggtcgttgatcaaaatgatcaacgggcaggattgaatggggagccgggcgggtttaatttaacgggtttcggacgggtcaaaattctaattgggtcgttttaattgggtgcaattgggggttccaattgaggctgaaattgaaacaaaaatgagctagttcttaaataaccatttttccctttttaattaattaaaataactaaaagcaatttaaaaacaaattaagaatactgaactaattaataacatataaaaatagtctaaaaaatattaggaacaattttataattataaaacgtggttaattgtaaaataggctataattgtaatttcatgcaatttagttttagaaattccaaataaattttaaaaatatgcaaaaattatattaattatattttgttgtaaatatgagagtgaaatacattattcatcaagaaatgataatttggaaataattttggattttatactgttaaaataggtagtaaattgattttaaaaaatcttaaaaattgaggaaaaataccaaaacctttgggcatgtttatatatgcatacatatgttattttgaaagtattttgagtataaaaaatacatagggaaaaattggatatcaacagctgcccctctttacccgaggaggatgaaagagttgtcgggtaaagataagatggccaattttaaccgggaacgacgattgtaaaagaattttgaccgcgctctggtttctgagctgcctacatatccctggttttgcaggaatcagtccatatgtagttcaggaaccattgacggaatgtgtcgatggagattcgaaaagacggacacgatggctgagtttgaaaaataatttggaatcagataggttgcagagaaccagagcgggatcgctcttgctgagatggccgtttgctagccagcgtacctgtaaatgagcaatgtgcgcatatattgtgcaaaatttaaacatgatgcaagttcccgttggaccatgaatgttgtcttcagacggttaggatgtcgtcctcagactatgatgtcctgggccatgaagagcacaaaagtaaagattcgcaggccatgaaatggtgttctcaggctatgcagatggtgcctccaaactatgacgcatttgaatagattggcgatcttgcagcccatgagaaggtggcaatctttcagccaaatgaatgcaaagagtggcgatctttcagctagagcgtgaattaaaataaggtggcgatgtttcagccgaagcaagaattaaaaatgcaagtggcgatattttagccgaatgaatgcaaagagtggcgatctttcagccagagcgtgaattaaaatgaggtggcgatgtttcagccgaagcaagaattaaaaatgcaagtggcaatatttcagctgaatgaatgcaaggagtggcgatatttcagtcatgcaggatggagacaatgcttagtctcggaagacagagaacagccttatgcaaaatgcaggatggagacagagcttagtctcgaaaggcagatgagtagccttatgcaggatggaggtagagcttaacctcggaaggcagatagatagccttatgcaaaaatgcagatggagacagagcttagtctcgaaaggcagataaatagcgccatgcaggatggagacaatgcttagtctcggaagacagaatagatagccttatgcaaaatgcaggatggagacagagcttagtctcgaaaggtagataaatagccttatgcaggatggaggtagaacttaacctcagaaggaagaacagatagccttatgcaaaaatgcagatggagacagagcttagtctcgaaaggtagataagtagccttatacaggatggaggtagagcttaacctcgaaaggcagagaatagccttatgcaaaaatgcagatggaaacagagcttagtctcgaaggcagataagtagccttatgcaggatggaggtagagcttaacctcgaaaggtagagaatagccttatgcaaaatgtagatggagacagagcttagtctcggaaggcagagaatagccttatgcaaaatgcagatggagacagagcttagtctcgaaaggcagataagtagccttatgcaatgcaggaatgtaaaggagcgaattgtagtaagttttcttagctgatagacggttgtgatatcgtgactattggggaatgttgggtggagatagtagacttgtgaatgagtgatcgttccgagagttttggctttgaagagtaaatgtattcaatgatttgcgatctgggcgcctgcatccaaagaaaaatcatgagttctgtagaggggggaaggttagtttgtatcccctggctctttgacatcgcgtatcgttggggtagcgttgctaaacgatagcattccaaatgatgtttatgcatgacttagtaaatataatgtaagtacatatattttgaaaaacgattttattttgattgaaccaacgactgcaacgtggttcaagacacgacaaccttgcttgttccggaattttgagggtcctcctcaaaattctgccccagtttactgggctagcgctgttaacggctgtgcttattaactgaaagcggatctattccagaattttgagggacctccttaaaattatgccccagtttactaggttgatgctgatgaggagactgaccaattgtcttcggaattttgagtgttctcctcaaaattctgccctagttccaatagcggggaaaatggaatttctattaaaatgtgatcgaacccatagggctgcctacgtatccccttttaaatgggaatcaggtcaggcgtagttcaaattacatcatgaagaaagaaaaacatgtgatcaaatgtagtatcgcttgactacgtccgagatgattagccttggctagacttctccatctatttctgcaagaataagggcccctccagttagaacccggtgaaccatgtacggaccctgccaattgggagagaatttccccttggattcatcttgatgtggaaatatcttcttcaacaccagctgccccggtgtaaacttcctcggcttgaccctcttgttgaaggccctggacattcttttttgacataactgaccgtggcagactgcattcattctcttctcatctataagggctaactgctcgtagtgaccttttgcccattctgcgtcatccagctctgcttcctgtatgatcctcaaagagggaatttgtacttcggtgggaatgaccacctccgtgccataaaccaacatgtagggagttgccccggttgatgtgcggactgtggtacaatagcccaataagatgaatgacaacttctcatgccattgtctgtgcctttcgatcatcttccttagtatctttttatgttcttattggctgcttcttcagctccgttcatctgaggtcggtaagctgtggagttcttgtgtttgatcttgaaagtctcacatattgctttcatcgggtcactgttgagattggaaccattgtcggtgatgattgactctggaatcccgaaccgacaaacaacacggtcgcagacaaagtctgccacaactttcttggttactactttatatgatgctgcttcaacccatttggtaaagtaatcgatcgccactaaaatgaacctgttcccgtttaacgcggcaggctcgattggtccaataacatccattccccaagcggcgaacggccatggaaagcttgttgcattaagctcatttggaggtacttttatcatatttgcgtgtatctgacagtgatggcactttcggacatactggatgcagtccgtttccataatcatccaaaaataccctgctcggagtatcttcttcgctaagacaaaaccattcatgtgcggtccgcaggtccctgcgtgcacttcatctagcagtttggtagcttctctcgcatcgacacacctcaacaatcccaaatcaggagtcctcctgtacaggattcctccgctgtgaaagaagttattggataatctccgaagcgtgcgcttctgagtagcattggcaagctctggatattctcctgtggtaaaatactctttgatgtcatggaaccaaggtttcccatcggcttcttcctcaacatgagcacaataagatggttggtcgtgaatcttgacctggatgagatcaatgaaatttgtatctggatgttgaatcatggatgataaggtggctagtgcatccgcgaactcattctgtattctgggaacatgttgcaattccgtctttctgaatcttttcctcaattcctgtatgtgatgtagataagggagtatcttaggattcttggttgcccattcttctcaaacctgatgtatgaggaggtccgagtctccgatcactagtaactcctgaatgttcatatcgatggccagtttgagccctagaatgcaagcttcatactcgtccatgttgttggtgcaagggaacgtgagcttggcggacaccgggtaatgctgaccgatttcttataccaggaccgctcctataccaactcctttgaaattcacggctccgtaaaaaaacatcctccaaccatcataggattctgcaatggcttcccctatgaaagctacctcttcatcaggaaaatacgtcttcagaggttcgtattctcctcccacgggattttcggcgagatgatccgccaaaacctgtcctttgactgccttttgagtgacgtaaacaatgttgaactcgcttagcaggatttgccatttggcgagcttgccagtaggcatgggcttctgaaagatatactttaacggatccatccttgatatgagataagtggtgtaagcccagaaataatgcctcaatttctgagctacccaggtcaaagcacaacaggtgcgttctagtaaggaataatgagcctcgtacggggtaaacttcttgctgagttagcagatggcttgctcctttcttcccatttcgtcatgttatcctaaaacacaaccaaaggctccatccaatactgcgagatagagcataaggggtcttcccggcttaggcggaaccaagactggcggcgtggacaagtattccttgattctgtcaaaagccttttgacagtcgtcagtccatttagtggcagcatccttctttagcatcttgaagataggttcacaaatgacagtggactgggctatgaatcggctgatatagttgagtcttcccaaaaaattcatcacatccttcttgttctttggcggtggtaactcttgaatggacttgacctttgacggatccaattctattcctcggcgactcacaatgaaatccaataactttccagcaggaaccctgagtgcacacttggcatgattcaatttcaagttgtacctcctcagtatgttaaagaactttcgcaagtcttccatatgatctgcagctttcttggacttgatgatgatgtcatccacatatacctcgatttctttatgtatcatgtcatgaaagatggtagtcatggctctcatgtaggtagcaccggtattttttaacccaaatgacatcattctgtaatagtacatcccccacggcgtgataaacgccgttttctctgcatctttttcatccattcatatctgatggtatctagcaaaacaatcgacgaatgactgcagctcatacttggcgcagttgtcgatcaagatgtgtatattttgcaaagggaagtcgtctttgggactggcccggttaagatctcggtagtcgacatagactctaaccttcctatccttcttcagtactgtcacgttgttggctaaccacgtcggatattctaccactcttctttgaactttctgaccttctgttttaccggtgggcatgttggatctgttggaaatttgtgaacgacgatggatgtgctgagaccagtcatatcgtcataagaccatgcaaagatgtcctcatactcttttaggaactctgtgtactctttcttttttgatggcgacaaatgtacgcttataagtgtttccttgacattctcgatgtcacccaaattaatgacctcagtttcgtcaaaattagacttaggcctatagttctcaacctctctgacgacctcttctggtatatcatcctcttctgaatctatatccgtttgttgcattgcctcgttgcaagtcacaatcgttggttcatcgtcaagatatgtaatagtaatgctgtgtaaagtaaagtaaatgatagagaaaagtaatgagagtgagatatataataaacttgaaattctttgattgaattcataattgtttgaaacatcgaagctcttttcaaaagtaaagacaatgcagaaagaaaacaaatcaactagtaaaaggtagaaaaaatgcgatgcacgatgctttgtttagccttgctaccccgaagctgttcgtgccttggttgtcctgatcgaccaattggtggcgcgctcccctcgattcacagcttttatggaaggaccttcctccccttcctcctcgaagataacacaacaatccatatcatcttccagaaataggttcttcatcgctgccagtgcctcgtcttcctctgatccatatataatgtcagctggttgaaaggtctgctccagctgaggtataggatgctccaataggtaatagggaccgcaccatggtggcaaccaatggttgaactcctcccaagtgtactcataccctaggccaaaactggtactgtgcttcttcagcttgataggtttggttataccctgtagattcttgccaagtccttttccgggctcatacccgctccaattcaggatgctctcaatcttgttatcccaccacttgtctttgtccacagcattgacccgctcgatgtggtggtatgtttctctacctattctccgtcagccttcgatcatcgggatggtttagcgactgtatatagggttgctaccgtcgccatgggtgatcacttcctgatgattccattcaaatttcacagcctgatgtaaggtcgatgccacagccccagcggcgtggatccaaggttgccccatcaataaattgtaggatgccgacacgtctatgacttggaagtccacatcaaaccaggtaggtcccatctgcaagcacaggctaattttcgtggatctttgggacccatcgaaagctttgacgctgacagctctatctttgatttcgtgcaaacctttccccaatgttctgagggttatcagtggacaaatattaaaactagagcctccgtcgactaggattctggtgatgaaataatctttgcattgcacggtgatatgcaacgccttgttgtgactaagtccttctggcggtaactcatcctcgtggaaggtgatcttgtggctttctagcacctgtcctaacatgttcgccatttcacctcctgttatgttgctgggaatatgagcttcacttaatatcttcattaaggcatttttatgtgcctcagagctttgcaggagagccaggatggaaatctgtgctggtgttttgttcagttgctcaacgactgagtactctttgacctgtatcttcctccaaaggtcatcgggtccagtttcaacaggtcgcccagaggcttgcttgctggactcggttagatgttccggggtgtataccctgcctgttctggtcatgccctgtgcaacgatcgcttctccagtatgtattttccctttccttctagcctgagctgtgtaatcccaaggtatggcgtttgacttgaacggggtcacgtctgtcatggaaaccggaatcggcaccctcgagggtaacacaacaacttcaaactgtgcaggtgattttgggatctcaaactcaacctcaattggctttggcgcctttgcaggaggtgcttcgaactcgagcggcacagacacgtttaccacatcgccctcagaaggctgaatctgaacaacaatgggattgagggtaaccgtcggcttcttaggttcatctccttcagctatcaacccgattgaccctctggggtcccaatcatcctcaatctcgatcatatggatgcctccacccttgtggtcgggcagagggttgttgcagacattgggagcgggctcctttgctacaatgaccttgttatcaatcaaagtcggaatcttgtctttcaacgagcgacactcgtcgatggtatggcctttcatcccggaatggtatgcgcaagtcttgtttggattgacccattgggaggaattttctggagttacggctgggataggggtaacataaccggctgctttgagtttatcatatagtttgtcaattggttcggcaatggcggtatactgtctgggaggtttgcagtcgaaatttggtctgggttgggcaaagttttggcgagtaggtggtgatgggtagtgagaaggttgggagttatatgcttggtatacaggtgcgggttggaaatatcttggtgaggtgggtttatatgtgggtgttggagatgattggtaggcgggtggtgggatttggtaagtgggtgatggtgcttggtaatttaaggaaggttgatacgtgagtggagttgaggggtatgtccggtacttcataggggaattgtttctttgcgtagccattacagaattcacgtcctttttctttgacgtgccaccagactgtaaggccttgttggtagcttgtagtgcttcgaggttagtgaccataccattctagataccttcttcgatcctttctcccaacttgatgatgtcggagaatttctgaccctctatcaacattagcctcttatagtactgcggatcttgagcccggacaaagaaccggttcatctgttcttcctcgtgggccggcctgaccttggcggcttctgacctccaacgagtagcatactcgcgaaaggtttctgtgggcttcttattcaaatactgaatatagaacacatccggtgcgttttcagtgttgaacctaaatcggttcataaagtcagatgccatgcttacccaactcgtccatttctttgcatcctggctgaggtaccaggacatggcgtcgcctttcagactcctcatgaacagcttcatgcggattttctcgtcctttccaactcctaccagcttatcgcaatacattctgaggtggaccctaggatcacccgtaccgtcgaacatttcgaacttgggaggtttgtacccctccgggagttggacatctggctgaacacagagatcttcataatttaatccttcaacacctttgctaccttcgacaccctggatccggctagttaacttcttgagttcagcagctaagttctgaatgagggagtccttgttatctgtttcgggtatgtctgagatggcgtgggtatattggggtatagtatccacaaagatgggagtgttatggtcgttgtggtgttttggggctcgggaatgagcagcggagtgttgttgcatgtgtttcaggcttgggtatgagcaggttgtgccggtggttgtggaggtgcagggttctggttgttggcatcagcagcggcaagagtgattgacaggcttcccaggtttcggacttgttctaattcttcccgaaatctcagcaaagtctgctcaagatgagtagcagtttccttggtaattggagtgttctgagaagtttcctcaatttcctttctagcatttgcatatcccatttttcatttgttcctgtttctggtaggactcggaggaggaggaggtggaggaaccttggatcttgttgagtatgctgatggtgccagaatgcacgaactaaccttttggggaggggaataaaaataaaagaaaaacaaaacaggtaaaaagttagtgcggattctaagaaggaaaatattgcgatattaaaacacattgtgcggaaatataagtcgtttcctaatttgggtgcctcattgtgcccgaggtaggcctagcgacaaattaaatttggagaacttataatgctaaatgccatattttattgataaaaacaagacgagtcttagaaaaacaactaaataataaaagatgtcactagtggccagtggccttattacactaggaaagcaggaaataaaagatcttaactacttggtcccagaaggaccttccccagatccggtatcttgcctctctcgtatagctgcaccagctcgcgtagtcccaacagtaaataggctcgggccaggtgtttgcccgtatttccttcagcattcttgcaatcgtcgatccttttcagaaatttaccttccagttccactaagcctcgctccagatatcctagccggttgttggcgttgacagccatatctttccatttatcgatcaacttctggtgagcttcttgtatctcccggtgctcattttcacattctcgcatcctcttgcgcagttgattgtatttaacccgtgcttcagtcttcacatcaatgagcctatgaccatggacaaaccctgggtggcccaaaccaatgtgatcgtcttctaaccaacccgaatagtgcggcatactcccttcatgatacctgtctgctttgatagactctcttcccaaaacgagcttgcaatgccacatatgctgagcttgacacctgcacgggctatcgtcgtcttgaaagtcagccttgacgtgactcatcttatctacccttggtacgatttgtttcctccctgcttgcgtcatagctcggagagggacataagggtaagttcctcttaagccaatgagtatgaggaatggtgcatctcgagaccaaacaatgaattccccagttgggaaccactcatacatccattttacctgttcctccttcagattttcaaataattctacccatcctctagcgtcctctggttgagcgaacatgttgggcatgaagttcattcgctttgggtggtgaaaagcgatatggtcatcccaatccctgcgtatgatttcttgtctgtagtcgcctttctgaaggtgttctataagccaaagttagagtagcaagttatacccttcaaagtgtttggccccttgctgacatttctctaaggctcgatacatctcggtaatgatcatgggcactatgctgaagttttgcccatcaataccttccattaaggttctggttaccatggctagtctggtgtggatcctagccttcttcatgggaaagatcatcatacccaagaaatagaacatgaacacaaagacccttctatgtatatgccctaaggaagtgagggcgaactcgtccatgtaggtgcgataggacttgctatggccgaatctttcatacaggaagtcaaatggtatgtaggaatccttcaaacaggtcagatccggattcttcttgagttccatcattttgaggaaactcctacccttgcgattttctagcataagtagacccggagtctcccaaggaatcccagctagaccccctatctcttctagcaaaggggtcatttcgaggtccccgaagtgaaaaacctaccgatcactgtcccagaacaaggtagcagcttcaataattttattgtcaggccggacttccaggagtgaaggaagatttcctaggtatttgcggacgagggtccgatcactggcatgaaggtcctcccaccagcttaacaatctcaggtgaatgttggataccataccgaatctggggacttcgtgcctcattttctgcaaaacaaagtgttaggcccttaaccccaccatactcgactatttaaatcaataattagcaataaaggcacttagttctccaaaaaaatgcacacaacgtgaaggcgaccgtttgggtttcaaggaaacccgatggacttcggtttaggctatcttaatgagtcattatgcggacaacataactgactcggctaagtttgaccatgatgcatgaatagtgtaacggaataaggtttctacttttgaagtgctagacaaggtacccttgagcggacaactcaagagggaaaggcgcggaaccgtcgactacactgttgatcgactggttttaccgcaaatatgcttttgccacatttagggagtttataatatcggaagggcacaaccactcattataagcattgctatgagatttgttttggcacgagtggagtatgatgctgaagaatgcagttacaaaaatgaaataaattgcatgtattttcacgttcataaagtagagattacaataaatgctcaaaaattacaacgacattgaaataatagtaaagcagtaaaagaagaaattaaaataaaaggaaaacatgaagccaagttagtaatcatgatgaaataataaaaggcaggaaataaagcaattaaggaagccatagagtcacaaaagcacttaatggtaaaagccttgaagaatttcccagcagagtcgccatgctgtcgacgccccctttttcccctaaagaaagcaaaatcgggtttacgacattatggataaaacagctcttattccttttgaggaatcaggttatggaatttgaagagtcgccacctaatgattatagtgcattaggacactttaaagaaaagaagaagactttggaagaaaaaccagagttcgggtaagggcttgagattatctcgaggggaaggtgttaggcacccctcaagatccactagtgtggttcccggccgtgctttaattgtgactttaagaagagtagaaggaaaacaaataaggtttgcacgtagtggctacaaataaacttgaaaatcttagaaagatgaaaggacataaatgatttattgttttaaaaaagagaaggagtaactggaagaaaacataaatttaagaaaagcattatacaaataaagaaaaaggaaaggggtcctaggtttaaatataatacgaatcacctcggtacaataccccgcacacactcctcagaagaggggtcgcctatgatattagcgcaccggtcatcatctccatattctaccctccccaccccgttaaggtattaaacgcggttagtctcgtttacttattgcatgctagtacccgtcctaacctatcagtcccggggtttttaggacttctaatcctgaggggaaaggaaagggagtatgggcatttgtggagtttcaaaaaggatgaaatactaaggcgacaatcaaaataaacagcaagtaatgaggaataaacaaacacacaaaggctcacataaaaccccgtaagtcacatagcatttagtttagcatgccttgcatatactgatttggtctttaaattgaaattaaatgggagacggactagtttaacacatagagttagataaaaagtccgcattaggcaacccggatccaactatcagaaattgaggtatttttagacagattattcagaaagtactgatttcaagcaagagcctaaggcagaagagtttaaaaacaaaagattgaaaatttgcagaagttcagagatgactttgaaatcagcagagttgtttaagtgaaatacggtagagttgtgcaaaagagtttagaaagtgaaaagactttaaaagtaagaataagttaaagactgtttcgaaatagcagcttcatcagatgaataaaaattcaggcagaaggtttaaaggcgttgttttacaagtctgaaaggaattaagaacattgcagatttataagagttttttgaaaacgaacaggtttggacgattaatatagaacaagaagaaataaagccaatagcaaaaatacatcacagcctacagctagatccgagcatcctaattcaatcttgatatccaatagcatgtgtttcaccaaatccggattccagattccaaggccttctcttattcaaagtgtttcaaagttccaaggagcctcgagagccccaagcaatgcttacactctgaataagaattgttgtgacagaatagtgcagtgtggaattaccagccctcatggcatacaagttgagagggaactccaaggtcccaaagcatggcttgcgaaaggggggcaaaatttaaaaactaggaataactgcaaagtgagagagggagccatagcagacggtggtcatacccagccatggcataggctggcatacccctgaccctccgcttaggtccaaacaattaggagcagactttagaagtcagacctgggtctagatggtgattaggacaccaccagaccacctaagtcgaggctcaacgcataaggggtagagggggtgggaactgatttgagtagaggctctagagaacctgattctaagtcatgagtggcaataatagaatgccaacatgactcagaattgcactcacacataagaggggtcaaggggaagggatttatatagaaaagcatacacggaacctttaaggaaagctaagaaagcataacagactgaaggtgcaaagacatagaataaagagcataacagattatgatatagttacatagtgcaagaaagcataaaataaacacatagtgaaggatgtgtagaagaggagaagtaaacacatagtatgagggtattatttaaactagaaggacataccagttgcaatcttagtacaacaaagcaagtaacagcaagtaaacagccagagagtcagcaggagcaaacttagaaacctcaggaactcaagaatgtttccacagtaggtagtaaaggagcagggtgttcagtaaagaaaacaatagtagaggaagtggtagtagagagagtagtagcagagagggtagtagcagtatatttcaaaggcagatgtgtctgtgtatcgaatgtgtgtgttgtgtcaagagaggagcatgtatttatacttgaagtcaggcaggtaagcaaggaaagaaaatagtccagtatcaattaggatcaatcaattaacagaggtttctttaattaagaaattccaatttgatcagtaaaggacaagagataattaaggaaaggggatcaaataaacaacattgcatagtatacaaataagggtaaatacataaatattatttatggacaaggtttttttgaaatacacggtttgtgcaaataaggtaagaagaccaattaacaaccagtaaataaaaggtctaagattttatatgaatgaatcaagtccgaaaaagggagaagggttttacttaggtcgagtcacgggcaaatggaaagaaatcaaccaggctatattcagaagaaagtttgaactaattgcaaatttgaataaccattcagagggaaattcatagtatataaggagcattcgaacatgttaagcatgaaagaagactgtagtgtcattgtaaacaatcagtaggataatccagtgtagaagagttttggcaaaaggtcagaaccatatgaaaacggagatgaattcagaaattagggcattgaaatcaaattagttcagagatgagaacaagcaagtcacatacaattggtctgaaaacccccaaattctagggttttcgtcattaatctagtgtagagacgaaagcaaacaaatcaggcaggagtaaattcagaaaacccaaaggaacttaaacgttccatgaaaatataatgagagaaaatacagtaaaagaaaattcaaggaaacgttaggaggaatcatagtagaagaaaatacataggaatcacagtagggcaaacacagtaagaataacacataaaaatcacagtagaacaagtaaagtcaaggaaaccctaagtcggagaagacgaacagttttgaaagcagagttttgaaagaggcttaagaaatcgtttgaaaatcttaaaataaacatggatctagagcagatctagaaaaaaactggaaaacctcgaaaggctagggtttcagaagaaccctagtagcgagaaaggcctggaaaagggcctgctccgagtcgaatgagtcagagatggactcatagggctaggatatgccggattcaagccggagatggccgcagaactcgaatcggcggagatcagagcaaaggtcttcaaggtcaggccttgaatcttcaagtaacaagggtataagggtacatgggggtgagtacaggccacccagggcttgggaggccattgattccggtgaaataaggtggaaaccggtagggtaggaccagggtttcggaaaggattagagagagtttgagagacaaagggattttagggcggccgtttgtgagaaatgaattagggttaggcgtgatttggaattaaaaaggaaagaaaggttatgggccgttgatcaaaatgatcaacggccaggattgaatggggagccgagcgggtttaattaaacgggtttgggacgggtcaaaattctaattggatcgttttaattgggtgcaattgggggttccaattgaggctgaaattgaaacaaaaatgggccagttcttaaataactatttttccctttttaattaattaaaataactaaaagcaatttaaaaataaattaagaatactaaaataattaataacatataaacaatagtctaaaaaatattaggaataattttataattataaaacgtggttaattgtaaaataggctataattgcaatttcgtgcaatttagttttagaaattccaaataaattctaaaaatatgtaaaaattatattaattatattttattgtaaatacgagagtgaaatacattattcatcaagaaatgataatttgaaaataattttggattttatactgttaaaataggtagtaaattaattttaaaaaatcttaaatattgaggaaaaataccaaaacctttgggcatgtttatatatgcatatatatgttattttgaaagtattttgagtataaaaaatacattgagaaaaattggatatcaacgctcatcatttcagtttcgaactccagatagtctacttcacttttagactatatgtacctctttttcttcatgttggaatatagtgaacagagttaaaaacttttcttgccttttcttttgtgcgtatggaacaaatagtctacttcacttttagactatatgcacctctttgtcttcatgttggaatatagtgaacagagttagaaacttttcttaccttttcttttgtgcgtatggaacagatagtgtacttcacttttggactatatgtacctctttgtcttcatgttggaatatagtgaacagagttagaaacttttcttaccttttcttttgtgcgtatggaacagatagtctacttcacttttagactatatgtacctctttttcttcatgttggaatatagtgaacagagttaaaaacttttcttaccttttcttttgtgcggggttttcttcttattaatctttgttgtttctgtttctagttatactagaagagcttgttgaatcttgtatgaaatattcatcacagtatgtgaaatatctttaaggacagtgttcttcacacgccaagctaaatcttattcacctcagaaattaatagtacctttctattcagtcaaagttaagtactcaaatcttactataaatagagccgaagaatgcatcaatttctccatccttcaatttcaattatcataactaagttttaacaaaagatgggttacaaggcatttctgtttcttggcctttttttggccatttttgtaatgataagctctgaggctttagctagggagttggctgagacttccaccatttcagaagaggactgtaagaaccctctcataatttgcataaatgttcaattctctacttaattcaatgttgtcctatttttattttgtgaaattatttaacctttccaattagagtttaacctgtcataaagatactatttaaatcccagtaaaacaagtaggtacctaaactgtagtttgaaataaccacatatttactaagttgtatgattactaggataataataacacgatacattaattacaattgtattagtggatctgtaaactttactactgttagcttgaccaagatagaagcgggtctttaagaggatgtgtgtactattataaagatgtggatttaaaatttatatttgacgtgcttaactttaggtacacttttgaaattataggttcaaaattatattctttttaaaattttagatatattcacgtatatatatatatatatatatatatatatatatatatatatatatatatatatgtactccattccaaaaataagtctgtctgaagtgggatttgaatcgtcaatttcatgtagaggtgcaactattacaccagaagagtctttgagcgtgtgtgcacgcacatataattaagtacttttcaagaaatgtaatattgttatatatgatttgatgagagtatgagttcacatgaatccatatcctatgacctagatacgcccctagaccaagactcttagggctcgctttgtatgagggataagggatacttaatccgggaattaaattttaaaaaagttttcaacgtttggttgggataatataatggtataactgatcccgcaaatagttatcccgaggttgttgcattatttttatatctatgggagggtagaataataatcacggaataattaatcccggaaaagcatattttaagccttctaaaatataatcataaatcttactactttatggattacatattttcttcgtaattctgtgtaaggatcacatataataagctaaaaaaaggaagaataacaaagcagttaaagaacaacattcttattttaacaaatgatgcagcaaagaaatccagtaacaagaatgaagtacataaagctcaaaacgactatggcggatatcctaatggcgtccgtggtggtggtggacgcccccgtggcggataccctgtccccggataccccgctgcccctggcggcggaggaatttccgctagtggtggcggatatcctaatggcgtccgtggtggtggacactcccgtggcggccgtggtggtggcggacgtggtggtggtggaggaaactgccgctatggttgctgcggccgccggaattatagttgcagcaggtgctgctcctacaaaggtgaggccatccatggataattaggtcaccatattgaagctaagcctcacaacttatcatcatgtggagcaatatataaaacctttgtgctttgtaaagcctcaagatgtaatagtaataatcttgcagctttttagggcttgttgtaataagttatgaataaaattatcatttaatatttgtgtttattatagaatggtgtgataacgttttcccttttgagcatgttgttcttttttttttttttttttttttttttttttttttacctataggagatttacttttagaagaattaacccaaataaccatccaccccaccacttaaattaaaaatagtcggtaaatgtataatatatgcataatttatgtgttacacgtgtacaattgtgtataattaatttataatctatgcatatggttagaaaaagtaaacaattaatatgatcggttatttatgtaatgatttacttttatacataagagacttgtataaattgcacgaattaatccaagagagcataaaaaacacactgtccataacaagagatgtggtgttcgagtctaggtatatggagtcgcatttgttaggaagcgctttaattatcccttaataagagattattcatcatgaattagaatttagctggaccacaatacggatattgaaaccgagtgagaaaagaaacacaaattaattaattttgatttccttcatcaaccaagctttcaaaattgaaaaggcaagaaaataacagaacccacgtcatatacttaagaaaggaggtctaaatcccgattatgtgacctcgaagggaggtctaaatcccaaatttgcaaaaccctccaattcttcctaaatccttagtttctactatggaagaacaaagattagggctagaaattaatcggtgatgttaaaaatggaacaaaatgagttcaagtgtataaacctatgaataggtgttgagttttctcctcaaaattgcctctaggccgagctctaacggagagtttatgaaaaattgaagaaatcccgtttttggaatgttctaaatcactggcgccagaccttctgacgcgatcgcggagcatagcatctcattggcctacgcattcgcgaatttcccttcgtgttggtgaatgctagcacctacccgcccccgcattcgcgatcctagtgtcgtattcacgaagagtaacggttagcttcctctcccaagcccatgcccctacgcgttcgcgagaagctggtcgcgttcttgaagagtaaaacccccaacactctgtgttcgcaacccaactatcgtgttcgcgatgaagaaaaccccctgtcccaaactccccttcacgatcgcgagaaaggcttcgcgattgcgaagcacatgacaccagatacaacagaaactcaagaaaccagatattttctaagttcaaatgatctgtaggctatctaaaacacaccggattactcggtgttccaaatcatgtgtacaaacgagtccaaaaacctcatatgaactcgctcgcatattcaaaataccaaaataacacctagaactacgaatcggacaccaaatcaaatgtaatttttaatgaaacttaagaatttctgtaccaagttcataaatatcgaaatggacctataccaagttccgaaactaaaattcggacccgatatcaacatagtcaaacataagtcaaatttatttgttctttaaacctttaaacattaaattttcaacaaattgcgataactcaagctagggacctcttaattcgattccggacatgcgcccgagtctcaaatcatgatgcggacccaccaggaaagtcaaaatatggatctgggtctgtttgctcaaaacgttgatcgaagtcaactcaaataattttttaaggcacgaattcacattttaatttatttttcacataaacgcttttcgaaaaaagatacggattgcgcatgcaaagcaagaaaggctaaaagaagctatttcaggttctgaaacaccgaattaaggcttaaaaccctagatgaccagtagggtcatcacacaaaatcaaatttgtgagatgaactcataccctcattttttgaaatatttaatgtttgcctagatatccttaatcatgattgcggaaacaccttcgcaatggcgaagtacaaattcaactgtcccagaatttcctctacgcgatcgcatacacactcacacgaacgtgaagcacaggcttcccaggcctacgtgatcaccgatagacccacatgttcgcatagattaatgcccgtggccagctcttgcctcctttcctctttgcgaatgacgcttagcccatacgttcgcaatgcacagattccttggcctacacgatcgcataccagaattagcgatcgcataccagaactagcgatcgcattgaacaaaataccacagcttctccaattagcctatgcgatcgggaccttcccactcgatggcgtttaaggaaaccagatcagtgcaccagaaaatttcagtaattctccaagtctaaatattgatctgttaatcatatgaaactcactcgaggcctcggagatctcaaccaaatatactaacaagtcctaaaaatgatacgaacttagtcgagctttcaaatcacatcaaacagtcctaaaactacgaatcatgcatcgattctcctaataaacttttgaacttctaacctctgcattcgataccgaaacctatcaaatcatggattgacctcaaattttaaacacaagtcaaaaatgacacaacaaacctactccaactctcggaaccaaaatccgagcatggtaacaacaaagtgaactctcaggcaaacttctaaatttctaaagtttttaattttccaactttcgccatttcaagcctaattcaattacaggcctccaattcactatctggacacgttcctaagtccaaaatcacccaatgaagctaagggagatgataattacatgtaaactaaaacaagaaatacatgattaagtctcaaataataaaaacatacctgacatgaccaaccatatcaataagaaatgaatggagatttattatacctttattcttacttccaacaaaaaaagatatatattttaccatactagaacacaaacaaatcaccatacatattcatattcctaatatgtaggtaactaattgtgagtcttagcttcagttaatttatccaagttttcatttcatcctctaaatccagtttcatgtccatgaaggtgtcaaatgccacaatttcttttaatgtacatctcgtaataactaatacagatctagattgttcaaaatatttgttcggttcattctttagttggacaatataatggccatttgtattgacaaatattaaacttacatctcttttccatactctacttgtgggatttcactgaatatgtcattattgtaagaaaattacatctcagacatcaagaagaaaatgtaattagaattttgaagaaggaatcatgcctttattattaacaatacaagagtaatcttattaaaaaaaataatacaggtaaaatcacgtgatgacccgataggtcatttatagttttaccatttatttctatattgtgagacctcgaatagctctgtttaaccttccttattttgtacgcagtccgtatctttttttccagaatgttttatgagaaaattgctaaaaatgtgaaaccatgccttaaaactcatttgagttgactacggttaatattttgtgtaagcagaaccggatcagtattttgatggtccagctagatccgtatcgtaatctaagacttgggtgtattctcgtaatcatattcggaagtcactagcttggtttaacgtaatttgttgaaaactagtcatttaaaggtttaaagaatttctaactttgaccgtagattgactttgttgctaccagattcagattttagtttcacaacttcatttaggttcatttcggtatttatgacttgtctgcaaaatttggtgcaaaatagagttgatttgacgtgattcggacaaccagttgtaaaattaaaagttcttaagtttatttgaaaatttcatttgttttagtgtctgattcgtggttctagatattattttaatttttggatcacacaagcaagttcgtatgatgttattatacttgtgtgcatgtttggtttggagcctgaggggatcgggtgagtttcagataggctacagaccatttaaatataggaaaaattgttggtcttggcttctgatgtcatctggtgtgttctacttcgcgatcacgaatatactcccccgatcgtgaagaataatttgagctggggaggatttttctcatcccgaatgctaggatttggtcacgaacgcgtagtagtggggggtctgccctttgccaacacaactactccattgcgaactctaagtgatacgaggcgggggagggaatggaactcttactctacgcgaacgcgagcctaggatcatgaaagcgaaggcgaagtgggctaagcctaggagaaagcatagagtttgtcgttatcgcgtaagctaactggcgatgcccttcgcgaacgcgtcaggtgtctcacaaaagtgatgaacacctggcgcccagtcatttaaacttcagaaatcgggatttcacctatttttcaccatcttctcattagagcacgacctagaagtgattttgaagagaaatttcatcatcatttcataggttagtgtagtttaactcgttttcttccatttccatcaacatccattgatttctaaccttaatatatgttctttcggggtagaaaattaggaatttggaaagaattatttttttttaaattacgatttagatctcaagttgaggccgaatttcaaaattaaacaaataatcatgctcgggggtgaatgggtaattgagttttggttcaaatcttgggtattgaccaagcaggaccggggttgatatttgttgacttttttggaaaaagtgtaaatatcttaactttatgtattataattgattttcctatcattttttatgttgttgagtttggttagattcgattagtttggaggtagattttagaccactgccataaggtattgcggaacatgggtatagctgagaccaatggggatcgattttgtagtgttttagatgactgattctggcaagaggtggttgagagattatatgttgactaaactaggggggttgcctacacttacttggggataagttttcatagctatttctagagatgttcattctgacactctaaaagagcattattccaggtagtttgggcgtcttcaatagggtagtatgattgtcacctagtacgaggctcgttttgtgtacatagcccgccatggcattatcttgattcccactaagagggatagagtgaggagattcattgattggctcacttacactatcagactacagatagccaaggagaccgagagtgatatttctttccagacggctgtagatatagctagatggatcgatatggttcgtgctcaggagagggggcaaatgtctgataagaggcctctccattttgatggtttccgtggtgcctcatctggaggcaggagtacttttggtgtaggccatcctcccaggccatttcagtcagcgcttcatccatctcatagtgcttcagggagtcgctgtccttatgtgcctcattctaagtagccagcctacagtgcaccatcagactgtatcactgccgctacgattcatatctatcactgtggttatccggctcgttcgggtcagcttcagctataacaaccacaacaacatgatgggtgttttgagtgtagaggtaatggtcgcatcaggaggttctgtccgagattattgggtaacataccacaaaaaaattcttgttccatggttccggcaccggttgctcaattgcccgctcatcttgctaagagcaagggtcaggcagccagaggtggaggttagatcattagaggtggatgtcaagtcattatacgtattggtcagtcagttagtggtggaggtcgggccgatagaggttatggccaaccacctatagtccatcctagagaagtagttaagactggtggggtccagcctcgattttatgttttcccagctaggcttgaggccgagtcatttgacgtcgttatcacatgtattgttccagttttccatagagatgcttcagttctatttgatccgggctctactaattcctacgcgtcatcctacttttcttcttatttagttgtgcctcgtgattctttgagtgcacctatgtatgtgtccgtgcttgtaagagatttattgttgtagatcgtgtccatcgctcgtttgtgattacaattgggcgtcttgagactagggtagatatcctacttcttgatatggtagattttgatgttatcttaggtatggattggatgtcatattatcatgcaatattggactatcatgccaagatagtgaccttatccatgtcggggttgccttgattagagtggaggggaatcatgttcattctaccagtatggttatctcttatgtgaaggctcaatgtatggtcgcgaaggggtttctagcttatttggattatattcgcgattctaatgcgaaggttacttccatggacttagtaccagttgttcgtgagtttccagaggtgattcctgcaaatctgtcggggaatccacccgacagggatattgacttctatattaatttgactccggttgctcaacccatttctattccaccatatcatatggccctgccagagatgaaagaattgaaagagcaattaaaagatttacttgatacaggcttcattagactcggtgtctcaccctgggtgtgcccgtgttgtttgtaaagaagaaagatgggtagatgaagatatgtatagacttttggcatttgaacaaagtcactatcaagaaaaagtatttgttgccgaggattgatggcttatttgatcagctccagggttccgaggtgattttgaagattgatttgaggtctggccactatcagatgaagattagggcatctgatttctctaagacggcttttcgaactcggtatgggcattatgagctcctagtgatattatttgggttgacaaatgccccagtaacatttatggatttgatgaatggggtatttaagccctatttggattcttttgtgattttattcattgacgatatcttgatctactaccgcagtcgagaggagcatgaacaacatcttcatattgtacttcagactttgagggatagtcagttatatgccaaacttccaaagtgtgagttttggttagactcagtcgcctttttggggtatgttgtattggtagagggcataaaggtggatcctaagaatattgatgtacttcagaactggcctagacctacttcagctatagagatccaaaattttcttggtttggcgggttattatatcctattcgtggaggagttttcatccacaacatcccattgactcgattaacccagaagggtgacccatttagaaggtcggatgagtatgatttgagctttcagaagctcaagatcgctgttggtgttggtattgcccaccgattcaggattctacatggtgtattgtgatgcatctcatattaggctcggtgcagtattaatgcagtatgatagggtgattgcatacgcgtcgtggtagttaaaggttcacaggaagaattaccatgtttgtgacttagagttggtagcctttgtgcttgtgctgaagatttggaggcactatctttatggcatgtcgtgtgaagtattcacggatcatcggagtctatagtattttttcaagtagaaggatctcaacttgaggtagaggaggaggctggagctgttgaaagactatgatattaccattttgtatcataccgggatgaccaatgtggtggacgatgccttgagtagaaagactgtgagtatgggtagccctgcgtatattccagttagtgagaggcccattgcatcatatgttcaggctttggccaatcagcttgtgaggttagatgttttgttgcctagtcgtgttctagcttgcacagtcgctctgtcacccttgtatgagcgtatcagagagtgtcagtatgattatccccattttcttgttcttatggaagcggtgtggcacggtgtttccaagtaggttactcttggagatgatggagttttacggatgtaggatcgtatttatgtgcccaatgtggatgagcttagtgagttgattcttgaagaggtccacagttcccggtattctattcatccgggtgccgccaagatataccagtgcttgaggtagcattattgctggaggaggatgaagaaggacatcgttacatatgtagctctgtgtctaaattgtcaacaagtaaagtacgagcatcagatgcttagtggcttgcttcagaagctagagattcctgagtggaagtaagagcgttcactatagatttttttttttgactcccacggactcataagaagttcgacgcggtatgggtcactgtggaaaggttgaccaagtaggcgcatttcattcaattggtagttacctattctttagagcggttatctgagatctatatccgcgagatcgtccgtcttcacggtgtacttttgtctataatttctgatcgaggtacgcagttcacctcgtacatttggagggccatacaacatgagttagatacgccggttgagttgagaatatagtttcatccccagatggatggacagtcaaaacgcactatttagatattggaagatatgcttcgtgattgcgttattgatttttagagttcttgggatcagttattgcctcttagcgagttttccttcgacaacatctaccagtctagtattcagatggctccctataaggcattatatgggaggcaatgtcgttcgcgagtttgatggtttgagctcggggaggctcggtggttgggtatagatttggtttaggatgccttggataaggtcaaaattattcttgatcgacttcgcacggctcgtcaaggaagaagagttatgccgaccgtagagttcgtgatgttacattcatggctagagagagggcattgctccgggtttcacccatgaaggatgtgataaggttcgaaaggaaaggcaagttgagctctaggtataccgcgtcattcttgagattcttgagatagtgggtgaggtggcctactggcttgcacaaccacctagtttatcaaatgtccatccgattttccatgtgtctatgctctagaagtaacacggtgatccgtcccatgtgttagatttcagctcagtccaattggacaaggatttgacttatgaggaggatctggtggctatgctagcccggtaggtgccgcggttgaggtaagagttatccttcaatttgagtgcaatggagaggtcagccgatcgaggcagccacgtagaggtctaagtcggacatgcagaatagatatccaaactttttttaccagtccaggtacctttctatgtcctatcgaggacaaatgtttattttaaaggtggataatgtgatgacccgataggtcatttttagttctaaccttcatttctgtgttataaaacctcgattagctctgttatccttcctcgattacgtgcacagttcgtgtcctctttcgggaatgtattaataagaaaattgatgaaaatatgaaattgttccttaagaattcatttaagttgactacagtcaacattttatgtaaacggacccggatcagtattttgatggtcctagtgggtccgaatcgtgatttacggcttgggcatatgcccaaattgaattcgaaagtccctaacttgatctagcgtaaattgttgaaaactagtaatttaaaagtttaaagaattcctaagtttgaccgtaggttgactttgttgctataatgtttgaatttttgttccaaaacttggtataggttcattttagtgtttacaacgtgtccgcaaaatttggtgtaaagcgaaattgatttgacgtgattcggacgtccgattaaaaaaattcatgttcttaagtttcattgaaaatttcattcgttttggtctctgattcgtagttttaggggttattttgttgtttcaatagcgcgagcgagcttatatgatatttttggacttctgtgcatgtttggtttgtaggagagctcgggtcagtttaagataggtgaccgactatttgaagttaggaaaatttctcctttttgaagtcagctgttatctggtatattcttcttatgattgtgaagagtaatttgggctagggaggcttttctttatctcaaacgggatggttggtacatgaacgcgaaggtttgggtggtttcccttcgcgaaagcatagtgttgaggggcctgggaaagggatctgtggtttgctctactcgaacgcaagccctggctcgtgaatgcgaaggcctggtagagaagccttcacgaacgcatgaaaaaactcgcgaatgcgtaggccatttggatgttgcgcttcgtgaatgtggcaagcccttcgcgcatgcgaagaaggcctgacgcccagactttaaaatatcacaaacatgcaatttcacccatttttcaccgtattctcattagagctcggcctagaggcgatttgggagaaactattcattatcatttcataggttagtgtgttttaatttatttctctctatttctattaacacccattaatttctaactttaatctatgttctttcatgggagaaaattagggacttgtgaagaattgagggtttctgtaaatttgggatttaaacctcaaattgagatcagattttgaaattaattacatactggagctcgtggatatgggtaaatggattttgttccaaatctcggtttttgaccaagcgggctcagtgctagcttttgttgactttttggaaaaagtataaagatcttaatttttatgtattgtatttgatttccctcgcattaattgatgttattgagtcaatctgggttagattggtttggaggcgcatttagaggaaagactggggttgagctttgatttgcttgcggaagaaagtaagtgttggttctaatgttgatttgagggaattaggaacccgtgagctatgttctatgtgaattacatttccacgttttagcgcatttcattaattattttattccatgtcttaactgttacatgctttaattgtttcctatgtcttaacttgctacttgtcacttatttctctcatattaaaatattcaatttttccaagcctccatgattgtagttacttgccttaattgtcttatttgtataccttatattaattgccatatattggactatcttcttgctttgtattaattgtagccttttctcgatttgttcgaggttccattatgaattttcttttaaattctgtaatcgtagagattcttttgatttgagtggttgagttgatttcatttatttatttttcttatggatcgggttacacgccataacaggtgaaataacggatgattgatattgatatattgggatagggtttcacgccgcaacgaatttgtatatgatattgatacagtaaaataagacaggattatgatattgatacggtgaaataagggaggattatgatattgatattgatacggtgggatcggattgcacgttgcaatgggtgaaataatgtgggattgaagattgagtttatttttatgagttaactgacttacttttcccccgtttcttcatgttattattattatcataggaattaaagtcaataggggagtactattttatgatagataaatgacatgcattaataatagacgagaaaaatatcaaaagacacattgttattctaaaacctgtgatgaccctaaaggttatctcttattttagaagccaaaattgtattatgaggccttaagaaccactttttgtctcacctcgatttgcgtgagaaatccgaacgcgtttccagaaggctttaatgtgaagttttagaaaaataataaatttggcctttaaaatgggttaaagttgactttggtcaccattcttgttaaatggacccagaaccgtgaacagacaatcctgtaggatccgtagtaaaatatgggacttgaacgtacgcacggaatcgaattctgtggtcccaagctctagaaaagaatttttaaagaaaattatttggtggaaaatataaaggctttttgaaatgaaatgatgcgtgttcttgatggtaacgggcttgtattttgattttagagcccggtacaggtttaaaataataatttagttgaatttgcgaaatttggtaagaatcggaatttgtttggtataaatcggacctatggttgagaaagtaaattttttaatgttcttgggtaatttcatgaaattgaggttaaattcgtagttattgatgttcttttgatgatttgattgcacaagcaagtctgtatgatgttattagacttgcgtgcatgtttggtgtggagccctgagggctcgggtgagttttggataggccacagagtgaatttcgacttagagagattgctggtatgttgcagctatgtaacatgcctctgccctcgcaattgcaagatcaggcttcgaaaatgcgaagtgctctggtttgggaaagcgacctcagtgtcactaatgcgaaagaagcctgggcaggccctcttcgcaaatgcgaacactaggctgggaattgtgaagcccatcgcaaatgcgaagttttccttcgtagttgcgaagatgacagcattccaaagggttcgcaattgtgaacccctagtctcaattgcgacatctaagacctattaagtggatttttaataggattcttctccattttttcaacttttcaaaccctaaactcccatagatgattttcttgaagagagttcttccccaaatcataggtaaacgatttgtaactaattttcttcaagctataacatctttttacatgatttcgtttcaaaaacaaggggtttcatgggaaattgggtgtttttgggtagaagttaggattttcaaattttgggaatttagacctcgatttgaggtctgatttcaaaactaattacatatttgagttcctgagtgaatgggtgatcgggttttggttcgaattttgggttttgaccaagcaggcccggggtcaatttttgacttttggaggaaacaatggaaaacctattttcatgcattagaattggtctatttagcatttattaatgttattaagtaaattgtgactagatacaagcgaattggaggtggaaatgaggggtaaagcggtagttgaggcttaatcttgtcagtggattcgaggtaagtgtttgtcctaaccttagcttgagggaataggagttgttgtctatttgctaggtgtttgtatcgagtacgacctataggtgtggtgacaagtacctatacgatggtttcaagcatgaccgtgagtcttatatcatgattttgtaactctaatatgtatcgatcatactcaatttgatgattattaatgttggacaaagcttatgaaagtttcgtggtaattgattattgttgagaattggcacaagttgagtttcagtgttgtaaagtaattgttgaaaatgagattggttatagctgaatcccttgccgatatgttattgtcgatatcgttgattcccttcccggaatattattgttgatattgttttttcccttgccgggacgtattttttctattgtttgggcgaggaagagtgtaaagcacgaagggtgatgccttgcatgatattgtgaattagtgtaatacacgaagggtgatggtgttctaatattacgagtgctaatgcacgaaggataatgccgtgcccatgatttgagagttaatgcacgaagggtgttgtcgtgccgatattgtgaggaataatgcacgaagggtgatgtcgtgccatgattatgtgataagtaggatttaacgtgttttatgcccctacttgcctatgctttgagtataatttgctcacaggttgtgcttgattgcaggtttgagcaacaagggacgaaatgtcaaagatcggctcaaaaagaagtgaaacctgctcaagtagcaaagaccaagtgaagtaatggcagaaggaacctagtgcggaccgcacaaatgtgcccacggccgcactaggaggttcagagaagtgcagactcaggacttccatggtgcggccgcggttggaaatgtgcggcccgcgttcagctcacgcggccgcaccattatggcacgcggcccgcgttgcaaggttcagagaagataaggattcaggcaaaggcaagccatgtgaccgcgattgtcttcacgcggtccgcgccagacctccacgcggctgtactacactttctcgcggtccgcgccagatacctcagagagcatgaaatggaagtcaaacagccagtgcggccgcagtcataattgtgcggcccgaactgacctcgcaggccaattttgtctagtttttccaacccactataaatagaatattttactatttttaggttaagttgtattttctaaacaagagctgcgctcgtgagaacagagttttagcctattttggcacttgagcattaattttctccatagattcttgtagtttatctttagttattaattaatatggctaattcttcttctatttctttagtttctctttcaattatgtctagctaaacccattagctagggttgtggctcaaccctagtgtgggtaattaatgggtattgtcatctaatggtagattgatgttgggtgtttgttatttgggttaattttatgctttacttaaggattagtggttgcaaacactgattctagcttagtgggttttgactcttcttgagaaagagagtctattaccccaaaattgacccgacaaggaattgggatggacccatgagaattggtagccccaattaatgggttaaacctcgagagagtaattacccaacttgaactctagttgcttggtcaaattggcctacccaattggtctcgagagagccaattgggaaaaatcactctctctaccgagaggtgtgagagtgggtgcaattgtgcaacggttataacataagccccataatcgtcaatctacacttagtaatctttacccgttagttaaccacctaggtaattccatgaccctagtacctttctctatattaattacaacttagaaaatatccccttagcataatttagtcttaatatttagttgatattagtagtttttaaagaaaagaaaacccaaaaatgtttggagtgcaattaggagcacaaacataactctaggctaaatagtcattccaactccatctctagctctctgtggaaaaatcgatcccgaaccactattcgggtaaaggatgctagtgacccgctctcctacattagtgtagcgttgagttggcagcgatcaatttttggcaccgttgtcggggagcttacggtgtcgattatctgtttggttagttttgtgttttgcttctctttccttcttgttactaattctatttgtgtcaatcactcaggtacacatgtctttaaacggaaatgaccctcttggaaacgtggtcatgggggaggaggttgaggaccttgaacaagaagagattttacctcaagctcaaagacgaggtagaaatgctaatgcacctgttaatgcaaacgataacattccagaccctcctctacctccaccaagagtggcctcaagagttctacccaatcaagggtacgcaagtgacattgttcctccccgaatccgggcggggaactttcaaatcactaatgttatgttgaccttgctcgagcaaagagggtattttacgggcgcctccgatcaaaatgcatacatgcactaacaggggttcgtagatacatgctgaggtagtaagcagacaaacgtgtcggaggatgagttaagattgaggcttttcccgttctctcttcggggtaaagcattggatttgttagaaaggctccccaatcattccatcacaacgtgggatgaattggtggacaaatttttttccaagttcttttctccaagtcacatggcggcgctccgtgatgaaattttggctttcaaacaagagccaacagagctcttggacgaaatatgggagagatttaggactatggtgaaagagtgcccaaagaatgacatgaacgatgtgatgattcaacaaacgttctataggggcataaatacaacaaaccaatgtattgtgaatcaattagcctgtggaaattttatgaagcttccatacaatgaagcttgtgatgtcttagatgagttagccgatacttcttcggcatggcaaagtcgggcaaacgttcctcaaggtgatcctaatgtcatacatttgcataaggagttacatgaccacggcaaagccattgccgagcttacaacaacaataaatcagttggcgaaggcgcaattgcaacaagtacaaagcccgcgccaagtcaatgccatagaaggagtgaatatgatgaaaagcaggcaaagagggcaacaacctcaaggaaagtgtgacaacttttatgagggaaatttattttcgaatgagtgctatgatgatcaaagcgaggagcttcaatatgtcaataattactaaggcaaccgaggcaactcttcgaattaatggcaaccccaagggaattggggcaatcaacaaggtgataattggagcaataataaaaaccaaggaggaaattgggggaacaacaattcgggtaatcaaggaaattggaacgggaacaacaacaacaacaacaacaacaacaacaattggaacaacaacaatgggcaaggtggttggaataacaatggtggtcaaggtaatcgggggcaagtctttcaaaggcccaatgtatcaacaaccgaacaacccgcctccgtttcaatctcaagggtctagtccttcgggtaatgacatgggacggattgaaaacatgtttgtgacgacccaaagggtcatcaccggatttctcccttttcacgtgatttcgaggccttgaaaacctcgcttttagttgcctcaatgtgagtgcgcagtccgggcacgtagctggaaagcttttatgttgaaatatgtgaattctgtgaaaaatttaaagaaatttgatactaatataattaaagttgatcttggtcaacattttgggtaaacggacctggacccctgatgtgacggccccggagggtccatagaaaaatatgggactcgggcgtattcccggaatcgaaatccgaggtcccgagcccgagaaatgaatttttgaaagaaattgttttttggaaaataacatggaatcttgaaaagaaaatgagttagaaaatattggtatcgggcccgtattttggttccggtgcccggtacaggtcttaaatatgtgttaagcgcttcttgtaaagtgtggtcgaaatcggacgtcgtttggcgtgtttcgaacctaaatgtctgaagtttgaggtttatgaagttagaatgaaaagtgaggactttgaggttgattcctcgtttatgatgttattttggcgatgtgatcgcacgaggaagtccgtaggatgtttttgagattatatgtatgtttggtttggagccccgagggctcgggtaagttttgagtgtggcccgggaggtcttaaacttaacaagtatcagatgttgcaggttcaggtgttgcaggcccccagagcggccgtggtcatttctgcgcggtccgcgctggaagccgctcagccgcggtgcatttttgcgcggtttgcgtggctaagttcagagggccagcaaattccaggttgaccagcgcggccgcgtaccaaatcagtgtggtccgtgctgggtaggttcagagggttatgttctttccttcctcggcgcggccgcggtagatttttatccggtccacgccagccttcagtaaagtatatataagttcaggattttcagtcatttttcactttttcaaaacccaaaacataagaggcaattttccaaatgattcccttccttcaaaacgagtggtaagtgatttctaacttattttctttattccttaacatcttttaacatgatttcaacttcaatcaaagattttcataaatgggaattgggggtcttggttagaacctaggtttttttttttttctaaaattggggatttggaccaccatttgaggttcgatttcaaaactaatcatatattttgattcatggaggaatgggtaaccgggttttagtctgaacctcgagtttcgaccaggtgggcccgggggcatttttgacctttttaggaaaaaccttgtaaaaattattttcatgcattgtggttaattataatagtatttattgatgcattcaggcaatttgtggctagattcgagttgttttgtggtagaaccaatgggtaaagctatactagaggctttagttcagtttggatcattcgaggtaagtgtttgttctaatcttggcttgagggaataggattaggatattatttgctaattgctaaatgtggagtaaggtgtatatgcatggtgacgagtatctatacaccggagtctagcatgaccgtgagtcttaattgtgttttattcgggttttgtgatacatcttccttgttaaattgataagtttcatataatgtgaacggtttgaggaagaattatgatttttatactttggagcgttggctcgaagtagaatatgataattgagaaagaagtgattaagagaggaagtgccgtaattgttcccttgccgggatgcgtattttattattgtggttgctcccttaccgggatttaagtatcataagtattctcccttgtcgggatatttgtgctgttagttgtaccttgtcgggatttagtcgtgttgttctattcccttgccgggatttcttgcattaattgtttcttccctcacccctggattgcggttgttgtctcggtgagtacctggaatggccatggaagggtcgggttgcgcgccgcaataatattgaatgataaggatcgggttgcgtgccgcaacaatattgataggtatggatcgggttgcgcgccgcatcacctctaaatataaatagatcgggttgcacgctgcatcacctctaattataaatggatcggattgcacgccacatcatctctaaatataattggaacgggtagcgcgccgcaacagtgtatggattaagtgtgcttgttctcgtatgtggagtttcctgtgtttcctaatctgttgttattgcacagttttatttatttatccgaagacttgtatatctgatttgtcacaccccatagcatgcttcctcactcttagctgtttaaattagatctattttctgctattgcatatatatctgcacaggttgtttatggtaggtcctatctagcctcgtcactacttcgccggggttaggccaagctcttaccagcacacggggtcggttgtgctgatgctacactctatgcatctttttgcacagatccaagagcagcttttggaccgcagcagcagtattgagcgggagctgtcgtaattccaaggactcacgaggtagactagctggcgttcgcacgccgaagtcccttctatgaatttagtttgtttttcttgtatcgagacaaacatttatgtaatttcattccagacttgtttttagtactctatagcagtccgtgagctagtgacaccagactctgggtagaaatgtgtttcaacttccgcattttatttcagttatataagcttaaagtatttcgctttatttaattgctttcgcttaatcatattgttaagaagttatcaggaaaatgttttaaatattttgcttgcctagatccgatagtaggcgccatcacgactcccgatggtgggaaaatcctggtcgtgacaagttggtatcagagcactaggttacttaggtctcacaactcaccgacaaactcggtagagtttaagggatcgatacgaagacatctgtatttatccccagaggctacagagttaggaaaatttcactttgttcattctggtcgtgcgattctgtttctcgagtactgattgtctttctactctattctttcacagatggcgagaacacgtgcttcctcttctaccgcgcagcagcccgagcccccagcagcagcccctatcatgggcagagggcgaggctgaggctggggcagagctcagcccgaacaacagtcccagaggtggagcctcatgttgactatgatgaggaggttccagctccaacagctccagtgggcccagctcaggtcccagggggttgcatagccactccagtgcttcaggatgctttggtctgactggtaggctttttggagggcatctctagagtgggttttctcccagtagcaccagccacatcttaggctagggcaggagttcagactcccgctacacgtactccggagcaggtagctcctcaggcccaggttccagtagttcagccagttatggcagtccaaccgggtattgcggctcagaccagtgatagtgcggctatgtccgctgatgctctatggaggttggatagattcaccaagctcttcactaccacgtatagtggcacttcttcagaggatgctcagaatttcttattcagctgtcatgaggttctacggactctgggtgtggtggagaccaatgggatcgacttcgccactttccgtctagcaggatctgccaagacttggtggagggacttttgtttagccagaccagaagggtcgccatcatagacatgggatcagttttcagagttatttttggagaagtttctcctagctagtcagcgggatgcgctttgtaggcagtttgagcgtctccagcaggcccccatgtcagtcactcagtatgagactcggtttattgatcttgcacgccatgctattgtgatactccccaccgagagagagagagagagagggggtgcagaggtttattgatgggtttattccgccgatccgtcttcagatggccatgggtgccgggagtgagatttccttacaggaggcggccaatgcggcccgccggatagagatggtgcttactcagggaggtggtcatgggtctgataagaggccccgtcattcttgtagattcagtggtacctcgtctggaggtagggattcttatggtagaggccaccctccgaggccctttcagtcagctctccaggcctctcatggtactccaggcggtagtggttcttagccgtattattcttagcaacagacttttggtgcaccaccagctcccattagtgaaccaccacttcagagaagtttacgaggtgatcattctagtcggcagggtcaacctcagtcttctcagttgccgcattcaggcgggtgttatgagtgtcgagattatggtcacatcaggagggcttgcacgaggttgaggagtgctcagtcgtagcagcagggtcctcgtcctataattcaggcaccagtttccccacagactgcccagccaactagaagcgggggtagaggacatagaggtggaggtataggtcatagaggtgaagcttagacctccagaggtaggggtcagccagcagcagatcgtcccagggatgtgattcagggaggtggggcccaaccccgttgttatgccttgccagccaagcaagaggctgagttatcagatgctgtgattacaggtactattctggtttgtgatagagatgcttcagtgctatttgatcctggatctacgtattcatatgtgtcgtcctattttgcaccctatttggttatgcctagtcaggccttgagtattcctgtatatgtatctacaccagtggatgattctatagtggtcgaccgagttcatcgtgcctgtgttgtggcatttaggggtcttgagacccgtgttgatttgttgctcttagatatggtagatttcgacgacatattagggatggattggttgtccccatatcatgcgatcttggattgccatgccaagatcgtgaccttggagttaccagattttccccgactagagtggtgagggaccccgggtcataccactcgcagcgttatttcagatgtgaaggctcgacgtatggtcgagaaggggtgtctagcttatctggcttatgttcgtgactccagcgcagaggtcccgtatattgattatgttcctattgttcgggagttccccgaggttttcccttcagaactgtcgggcatgccacccaatagggatatcaatttttgtattgatctggctccgggcactcagcccatttccattcctccgtatcgcatggccacgccagagtggaaaaagttaaaggatcagcttcaggatttgcttgagaggggtttcattagacccagcgtttcgccttggggtgcaccaatgttatttgtgaagaaaaaggatggttcgatgaggatgtgcattgattgctggcaattgatcaaagttacgattaagaacaagtatccactgccgaggatcgatgatttattcgaccaacttcatggtgtgagggtgttttcaaagatagatttgagatatggctaccatcagctgaggattagggcatatgatgtccctaagacaacatttcgcactcggtatgggcattaagagtttctggtcatgtcatttgggttgactaatgccccagcagcgttcatggagttgatgaaccgagtgttcaggccgtattttgacttgttcgtgatagtcttcgttgatgatattcttatacactcccgcagtcaggaggagaatgagcagcacctcagagtggttcttcagactctgaaggatagtcagttatatgctaagttctcgaagtgcgagttttggttgagttcgattgcatttctgggtcatgtcgtatcaacagagggtattcaggtggacccgaagaagatagaggcagttaagtactggcgcagcttccgctatagagattcagagtttcttagggttagcaggttactaccgtcggttcgtggaggggttttcatccattgcagccccgataaccaggttgacccagaagggtgcccagttcaggtggtcagacgagtgtgaggcgagcatttagaagttcaagatagatccgactacgacaccggtattggttttgcccactggtttagggccttatacagtctattgtgatgcttcccgtattgggcttggtccagtattgatgcaggatggcaaggtcattgcctatgcttcgaggcagttgaagatctacgagaagaattatccggttcatgatcttgagttggcagccattgttcatgccttgaagatttggaggcattatctatatggtgtgacgtgtgaggtttacactgatcataagagtcttcagtatttgttcaagcagaaagagttgaatttgaggtagaggaggtggttagagttgctgaaggattatgatgttactatcttatatcacccggggaaggccaatgtagtggccgatgcattgagtaggaagtctgccagcataggcagtcttgcttatattccagttaaccagagatcgcttgctttggatgttcaggccttggccaatcgtcttgtgaggttggatatttctgagcctagaagagtgttaggttgcacggttgctcgatcttcattgttggagcatattcgtgagcggcagtttgaggatcccgatttatgtgtcctgagagacacggtgcagcgtggaagtgccaagaaagtgaccttgggagatgatggtgtattaagattgcaggggcgagtttgtgtgcctaatgttgatggtattcgggagttgatcttagtggaggcccatagctctcggtattctattcacccgggcgccgcgaagatgtatcaggatcagaggtagcactattggtggcggaggatgaaaaaggatatagtagcatatgtggctcgatgtttgaactgtcagcaggttaagtatgatcatcagaggctcggtgattcattttagaggattgagcttcccgagtggaagtgggagaggattacgatggatttcattactgaccttccgatgactcggaagaagtttgatgaagtttgggttattattgataggctgaccaagtcagcgcattttgttccggttgccaccacctattcgtccgagagattagctgagatttacatcagggagatcgttcgccttcatggggtgcctatatctatcatttcagaccggtgtacgcagtttacctcgcgctactggagagcagtccagcaggagttgggcacccaggttcagttgagtacagcgttccatccccaaaaggacggtcagtccgagaggactatttagattcttgaggatatgctccgagcctgtgttattaattttgcaggctcgtgagaccagtttttgcctttagcagagtttgcctacaacaacagctaccagtccaccattcagatggcttcgtatgaggcgttgtatggtaaacgatgtcggactccagtcggatggtttgagcctggagaggctcggttattgggtacggatttggttcaggaggccttggataaggtctatattattcaggataggcttcgtacagctcaatccaggcagaagagttatgcagactgcaaggtcagagatgttactttcatggttagtgagcgagtattgctccgtgtatcgcctatgaagggcgtgatgagattcgggaagaagggcaagtttagccctaggttcatcgatccatttgagattcttgatcgtgtgggagaggtggcttataaacttgccttgccacctagtttgttagctgtgcatccagtgtttcatgtatctatgctctggaaatatgacacgatccatcgcacgtgttatattttagcaatatccaattggacaaggatctgtcttatgaggaggagccggtggctattctagaccagcaggttcgacagttgaggtcgaagagttctcctttagtgcgtgttcagtggagaggtcagcctcctgaggcatcgacttgagagttcgagtctgatatgcggagccgttatcctcatctatttcccaactcaggtacttctttcttttgtccgttcgaggatgaacgattgttttagaggtggagaatgtgacgacctaaagggtcatcagcggatttctcccttttcccgtgcttccaaggccttgaaaacctcacttttagttgcctcgatgtgcgtgctcagtccaggcgcgtagccggaaagcgtttatgttgaaatatatgaattctgtaaaaaatttgaagaattttgatattaatatgattaaagttgaccttggtcaacctttttggtaaacgaacccggacctgtgatgtgacggtcccggagggtccgtaaaaaaatatgtgactcgggcgtatttccggaatcgaaatccgaggtcccgagcccgagaaatgaatttttgaaagaaattatttttctgaaaatgacatggaattttgaaaagaaaatgagttagaaaatattggtatcgggcccgtattttggttccggtgcctggtacaggtattaaatatgtgttaagcgcttcctgtaaagtttggtcgaaatcggacgtcgtttcacgtgtttcaaacctaaatgtctaaagtttgaggtttatgaagttagaatgaaaagtgaggactttgaggttgattactcgtttatgatgttattttggcgatgtgatcgcacgaggaagtccataggatgtttttgacattatatgtatgtttggtttgaagccccgagggctcgggtgagttttgagtgcagcccgggaggtcttaaacttaacaagtatcagatgttgcaggtccaggtattgcaggcccccagcgtggccgcggtgcatttttgcacggtcttcgtggcaaagttcagagggccagcaaattccaggtcgaccagcgcggccgcgcagcaaataagtgcggtccgcgctgggtagtttcagagggtcatgttctctccttcctcggcgcggccgcggtacatttttgtgcggtccgcgccagccttaagtaaagtatatataagttcgggattttcagtcatttttcactttttcaaaacccaaaacatacgaggcgattttccaaacgattcccttccttcaaaacgagtggtaagtgatttctaacttattttctttattccttaacatcttttaacatgatttcaacttcaatcaaagattttcataaatgggaattgggggtcttggttagaacctagttttttttctaaaattggggagttggacctcaatttgatgtccgatttcaaaactaatcatatatttggattcatgggggaatgggtaaccgggttttggtccgaacctcgagtttcgaccacgtgggcatgggggcatttttgatctttttaggaaaatccttgtaaaaattattttcatgcattggggttaattccttgccgggatttagtcgtgttgttgtattcccttgccgggatttcttgcattagttgttactcccctcgcccctggattgcggttgttgtttgggtgagtacctggaatggccatggaaggatggggttgcgcaccgcaacaatattgaatggtgaggatcgggttgcgcgccgcaacaatattgaatggtaaggatcgggttgtgcgccgcaacaatattgacaggtatggatcgggttgcgtgccacaacaatattgaatggtaaggatcggattgcgcgccgcaacagtattgactgctatggatcgggtttcacgccgcatcacctctaaatataaatggatcgggttgcacgccgcatcacctctaattataaatggatcgggttgcacgccgcttcatctctaaatataattggaacgggttgcgcgccgcaatagagtatggattaagtgtgctggttctcgtatgtggagtttcctatgtttccttatatgttgttattgcacaattttatttctttatccgatgacttgtatatctgatttgtcacaccccatagcatgctcccctccttcttagctgcttaaattagatatatttcctgctattgaatatatatctgcacaggttgtttttggtaggtcctgtctagcctcgtcactacttcgccggggttaggccaggcacttaccagcacatagggtcggttgtgctgatgctacactctgtgcatctttttgcacagatccaggagcagcttttggaccgcagcagcagtattgagcgggagctgtcttcagttcagggactcgcgaggtagcctagctggcgttcgcaggccgaagtcccttctgtgaatttagtttgtttttcttgtattaagtcaaaaatttatgtaatttcattccaggcttgtttttagtactctatagcagtccgtcagctagtgacaccagactctgggtagaaatgtgtttcaacttccgcattttatttcagttatatgagcttaaagtcttccgctttatttaattgctttcgtttaatcatattgttaagaagttattaggaaaatgttttaaatatttgccttgcctagctccgatagtaggcgccatcacgactcccgatggtggaaaaatccgggtcgtgacaatgttcgagcaaatgatgaaaaagaaccaagactccgatgctcaattggcctcccataacacttatatccgtaacttggaagtacaacttgaacaaatctctcaatctctcaacactcatccaaagggtgttctaccgagtgatacgatagtgaaccccaatcatgtgatggctataacaacgcgaagtgggagaggcggtgatgtacaagccttaagaggaaatcaagttatagttgatgaagaggagttgcgagatgatgatgtacccttggtggttgaggatgtaattgaaccaaatgtgagcaatgatgtgaggatcgaaattgatgagggtgaggaggagacacaagaggctgtgaacccgcctagggatcacatgattgatatgcccgaaccggtgctgccaaaagccaaggcacccttgcctaggcctcctctgccatatcctcaaaggttggcaaagcaaaagggtgacaaccaattcaagaaattcattgagaggatgaagagtttgactatcaacgtgcctttagtggaggcactcgagcaaatgccagggtacgcaaaattcatgaaggatctggtgacgaaaagaggtcaacggagtgtgagacaatcaagatgacgcatcaagtgagttctattgtacattccatagcaccaaaacttgaggatcccgaagcattcactataccttgtaccatcggaagcgccgactttgcaaaagccctttgtgatttgtgggcaagtataaacctaatgccatattcggtcttcatgactttgggaatcggaaaacctcatccaacttcaatgaagcttcaaatgagtattggtcaatgaagcgacccttgggaataattgatgatgtccttgttcgtgttgataaatttttcttgccggccgacttcgtcatattggattgtgaggtggactttgaagtccccattattcttggaagaccttttccacctacgaggaaggctttggttgatgttgaggcgggagagttaaccgtccgtgttggtgatgaaaaggtggtgttccacgtgtgcaaatctatgaggcaaccaaatagcaccgaggtgtgctcgtttgtttacattgtcatggcggtgatagtggatgacacaagcgcaatgattaatgttgaggatccacttgaggccatgcttttgaatatggatgtcgatgatgatgccgggagagtggagtgtgtaaacgcattgcatggtatgggctcgtattcttatgagcctaggaagttatccttggatcttgagaatcataaaactccaccaaccaagccatctattgaggagccgccggtgttggagttgaaaccacttcctccttacctcgggtatgaattcttgggccctaatttaacttttcctgttattctttcgtcttgcttaactaacgtgcaggttgacgccactttggcagttctacaaaagcgcaagatggcgattatgatgcattttgcatgcataagatcatattggaggaggatgcgaggccttcacttgaacatcaaaggagactcaatgaagctatgcaagaagtggttaagaaagaggttatcaagtggcttgacgccggtatggtgtatcccatttctgacagttcatggacttctccggtgcaaggtataacgaagaagggtgggatgaaggtggtgaccaatgacaataatgagcttattcctactcgtactgtgacgggttggagagtgtgtatggactaccggaagcttaacaaggtgactagaaaagatcatttctcatttccattccttgaccaaatgcttgatcgttttgcgggccgggctttctattgtttcttggatgggtactcgggatacaatcaaattctcattgccccggaagaccaagagaagactacttttacatgtccttatggtacattcgctttttctcgaatgccattcggattgtgtaatgctccggtgaccttccaacgttgtatgatggcaattttcaccgacatggtggaagatatattggaggtcttatggatgattttagtgtggttggggactcttttggagaatacttgcaaaacttggatcgagtgttggcccgatgtgaagacacaatcctagttctcaattgggagaagttccatttttggtagaagaaggtattgtgttgggtcacaagatttcaaagagaggtattgaagttgacaaggcacagatcgaggtgatttcgaggcttcctccccctacttctgtcaaaggggcgaggagttttcttgggcacgcgggtttctaccgaaggttcatcaaagatttatctaaggtagttaacccgttgtgcaaattgctagagaaatatgccaactatgtctttgatgagaaatgtatggaggctttcgagcttctaaagcacaagttgacaactacccctatcattaccgcaccaaattggagctttcctttcgagctcatgtgtgatgctagtgttgttgcggtgagggcggttttgggccaaagaatcaacaagatgttccatctggtgtactactcaaccaagacaatgaacgacactcaaaggaattacacggtcaccgagaaggaattgctagctattgttttttccatggaaaagttttgaccataccttatgggggcaaaagtgattatacataccgatcatgatgcccttaggtactttatgaccaagaaagatttcaaggagaggttaatgggatgtgtactacttcttcaggaatttgatttttaaattgtggatcgaaaagggagtgaaaaccaagtggcagacaacttgtcccgtttggaggaggaggggaggccctgtgacgaccttgatattaatgatgcatttccggatgaacaactcctcgcggtttcaatgcatgatatgtcgtggttttccgacatcgccaactatcttgttaccggtatagtcccgtatgagctctcttctaaccaaaggaagaagctcaagcgggattgcttggattactattgggatgagccgtatcttttcaagatttgcaccgatggtgtaattcgtgtgtccctgaagaagaagagttgagttttttggaagcttgtcactcttcgccatatggtggccatcatggcggggcgaggacgacttctaaggtgctttgttgcagattctattggccttccttgtttaaagacgccggtgactttgtcaagagccggtgggatttctaaaaaggatgagatgccccttaatacaattctagaggtggacatttttttatgattggggtatcgactttatgagtccgttcgtgagctcttgttggaatacctaaatcttggtggcggtagattatgtttcaaaatgggtcgaagtcatggctttgcccaacaatgaggcccgaagtgtggtggcatttctgaaaaagagtagctttacaaggtttggcactccacctgctatcattaatgatggtaggtcgcacttttgcaaccgagcttttgattcgttgcttgccaagtatggagtaaatcacaaggtgaccaccccctatcatcctcaagcgagtgtccaagtagaagtttccaaccgagaaattaagagtatcttgtctaaagctgtcaatgctaataggaccgattggtcaagaaaattggatgatgctctttgggcctaccagacggccttcaagaccccaatttgtacgtcgcggtaccggttggtgttttggaaggcttgtcatattccggtggaattggaacacaaggctatgtggaccttgaggaagttgaacttggaatgggatgttgcagcaaatctccgggttgaacaactcaatgagcttgacgagtttagatttcatgcctactccagctcgtccttgtaaaaggacaagatgaagtacctttgtgacaaatatgcccggggaaaggaattcaaggttggtgacatggttctttttttcaactcccggttgaggttattcccgggaaagctaaagtctaagtggagtggtccttttgaagttgttggtgtaaccccatttggtgctattgatctcaggaacaaaaatggtgaggtttttcgagtcaatgggcatcgtgtcaagcattatttggggaattttgatgacagccacgtggtggcacttattcatttgaagtgataataatggtaacatacgtcgtgccgcgacgatcaggcgcttcttgggaggcaacccatgtctttttctttctctttgatttttctttgtagattaggatttttgagctaatggtttgtgagatgttgcagggattgtgtcaaagcagtgcaaaacaaagtgcaaaattgcacagtctctgaagattgctggtgcggccgcggtaagtttggtgcggtccgcactggcataagttgaaaatgtaggttctctgaagtttcacctgaagtcccccttccatattttacctttccattgtctcttttctttcctagaacaattgtattttcttttcagaccagtatttgtagtaattcgtagatgttgttgaagttgtgtcaccagatccgagggtagacgtgtattggattatttgatcatgttataactcttccgcatttatcatctgtttaactttagtttctgtttataactgtttgggattgattgttgaatgtgtagaaccttaatagttggcgtgcctagcattcacgagtaggcaccatcacgactcccgagggtggaaaatactggtcatgataagttggtatcagacctctaggtttcttaggactcacaattcaagaacaagctaggtagagtcctagggatcgatacggagacgtctgtgcttatccccgagaggctagacagtttaggaaaaatttcacatctattcttctctgtcgtgcgatttgactcatcaatgctaattgaaattttactctgttctttcacaattggcgagaacacatgcttcttaatccattgatcagcagcccgagcccccagtggaagttcctacaagtggcagagcacgaggccaaggttgtaaggccatataaaatatttacccaaaaaccctaaatcttgtggtgccaagttaggactatgtgttagaaagttaaggaaagattgacctatgcattaaaaagttaggctgaggtttggacattttggattgatttgtgcattaaaaagttaagaaaaatatttttcagaagggtgcggttttgcggcccattgtgcggccgcataatcactttgcggaccgcataatggtcgcagagtgagacagaaagaggccagctatgcgaaccatttatgtgatcgcataataggtttgcaggccgcatagttgtcgtataatcattcttcagcttttgggatgggaggttctgtggagcattatgcgatcgcaaaacaggcctgcggaacgcatacctaccgcagaccctacccgggatgtcccaattctaagcttcaattgtgcgactactttgcgggccgcataacagttatgcggtcgcatattcgaccgtagatctatacccggggctcctaatttctaattttctgacccgaccctatgtcaatatattatatgctacccttcattctaggcctattttctgatgcatttagagagagtgggggggtcctagagggagaagcatttcttcatcaacatttctcctaagatcttgtttaaaccttgaagatctatcaagaaaggcacctaggtcttcttcctaagaggtaaggttctataacccgaactcttaattactagatataactagaatggaccatcagaagggcaatccatgaggatgggagtagatatcttgtatgcatgggttcttaaggtatttggtgaggtcttgagctaaggatgatataagggatagtaggatctttcacaaaaaggtcttaaaagcataatgcacacttagtgtttgaaaacatgctcaaatgagctagaactatgatcacctctctaatttgtgattcgatttgtcatgttcctaagagattgacgttgctaagagtctcagagtatagtaggacttaaggatagctcaatcgaggtatgtaggctaaactttctctctcgaaagtgaattccgtattgtttccgtaagtttaagtgtggtttgtctaccaaaatggtatagccttgagtcacattttaaatgaatagttagtatactaattaggtgagaagaattcgatctgcttaatgctcctagttgctcttatgtgtactaaatgccttgattgaatgtttctatttgttgataagctgtaaagatgtttggaaatgaatcgaatgagaaaaggtgaaaaaaattatgaaataagccttcacccaaccattatgaactaacttcagaaatagaatggcctaaaggtcttgtacccgaactatgcccataagaagttgttttagataatgattttccttataaatgcattcaatgtaatgcgagtccttacacattccgatgatgaaattgtgcatttatcatgatgggaaaggagtaattcaaggataactgaggtgattgcttgcttataacttcaatgtgtacttaaattattggttggcatgtccctctttgggaagaaccctttgtgtctgaagtttctattactaacgaactcgaaaatatatgatttctggaatattcaatacattgttattggttggtgaccctcggaaataacggaaataaaaatgtggaaaaccaagtggtgagccccactctcttacactcaaaatatgataagagagtgaataagagacacatggcatgactcggagccttgttgctggcattcctttatcactattcaattctacttagagggctccgtagattgtttgtgggtgatggttgatgttggaagtcaaaactagaaatattggtatttgataagcatgtttgtcatttaacctgtaaacttgtaatattttgaaaattatgaatgaagtcgttaacggaaatgaaatgaaagttgctaatggaagattgcttagtattttgtttaaataggataacatcccctctttattcatgaactagtttgaatagaatgaaatctaataggcttgctcaatagggtttactcgattgagtgccggtcacattccatggtttttggggcgtgctagaggccgaggccggggcagggctcagccaagagcagcagcaccagcagcggagcctcaggtagagtttgagggggacgctccagcccagaccgtttcagcagggccaactcaggtcccaaaggggttcatcgccaccccggtgctctaggatgctttggtccatctagtgggccttatggggagtgtcgcccaggcaggcttacttcatgtagcaccagctgtctctctagctgggggagcacagactcccattactcgcactccggagcagatggctccccaattttagactccagtagctaagccaattggggtagttcagctgggtattgtggctcagaccggtgatggagcagctatgtttgctgatgctttattgggttggacaggttcaccaagctcttcactactacttatggtggtacatctagagaggatccccaggactatttggacagcagtcacgatgttctttggaacatggggatagtggagaccaatagggttgacttcactgcttttcgtctgtcgggttctgccaagacttggtggagagatttttgtttggctagaccaactgggtcaccggctttgacttgggatcctctcatctatttctggagaagtttctacctatcactcagagagagggctatcagaggtagtttgagcatctccagtagggttctatgaccgtcactcagtactagaccaaattcattgccttagcccatcatgcaattatcataattcccaccgagagagagatggtgaggaggttcattgcgggactcgctcagcgtattcgattacagatggccaaggagacaaggagcgagatttcttttcaggatgcgaccaatgtggccaggagtgttgagatggttctatcacaggggagtggtcaggggtctaacaagatgcctcatcattctggaaagttcagtggtgcctcgtctagaggcagggattcttttggtagaggccattctcccaggccattttactcagcactccaggcttgtcacggtgctccaggtggcattggttctcatatgcagtattctgatcagtttccctacagtgcaagcatctatcagtgcaccaatgctccagagttttcatggtggttactcaggccgttagggtcagcagtctcagcagccgagggcttcttacacctgtggcgatacgaggcatattgctagattttaccctcaagcaccgagcagttcttagtatcagggttcccacagaatggtttaggcactgagcgttccaccgctcgtgcaactagctagaggtaggggtcaaggtgttagaggtggaggttaggctgttagaggtggaggtcaggcagctagaggtggaggccagccagcaggaggccgtcctcgggatgtagttcagagtggtgggggccaaccccaatgttatgctatcccagccagacctgagggtgaggcctccaatatagttatcacatgtacgatttcagtttacagtagagatgcctcagttctatttgatccggggtctacatattccaatgtgtcttcttagtttgccccttatctggttgttcctcatatttccttgtgtgcacatgtatatgtgtctgcaccggtgggtgattatattgttatagatcgagtctatcactcatgtgtggttattattgggggtcttgagacccgtgtagatctcttacttctcgatatagtagactttgatgtcattttagagatgggctggttatagccttatcatgttgtattggattgtcacgccaaggccgtgaccttagctttggcggattttcctcgattggagtggagagggactcccagtcattttatcagtagggttgtttcttacataaagtgttacaacccatatccacacactttagttcattccatatattagttaacatatatccaagaaggaattatcctttagatgataagaacttaatcatattggtcttaagtaatacaagggtgtataagggtgattaacaagtattagacgttaaacgaatcaaggatgttgtaactcataatttcaggtaaacctagaggtgcttaatacactaaggaggtcatgtattaaggtatttgaatcatataatatccgtatcataagccttgaagtcaaacgagttatgaaacaaaagtcgacaaaagttgtcgcaacttaggttcatagttttgcttaaactttaggtcaaatgttgttaagcttttctactaatgtacttggaattaaagggtgatataccgaccaaattgaatatctatgagtctagtttctaacgcattaaaccgttcgtcgatacgatctcggagtagagagatattcgcgttttcgcgagactgcgccaagcacctctccatggggcccactaaggcggtttgagaaatttggacctatataggatgcctccaaaccgtttttagtcatttattttcactattttcagaacttagaacccttggaactccctctcaagtttctctcaagattcaagacccatacaaagggcaaacaacacaaatcaagtgtcgggaatcccgtggcgctagtaagtctcttattcttcttgttgttgctcatttttgtgatgttctagctcgtgcgggaggttgttttaaagggtttaggttctgtaaatactccctcatgttcttaatatcaatcctaggtgatttcaagccttctaaagtgattctagtgccgaaaaacactaattgatcgctagtttcgctttcttgttgttgtggcagcattggagggatatttcatggaaacttaaggtcaaattggagtttttctttctgtataaaggtaaggaacctcttaccctatatgtatttaagattatccaagttgcggctaagccattgaagctagaacttgtgaaatatatatcgaaaggtttggtagtaatgttatcggttggtggactattttgggaggctaaatttgattattattgatgttgtttgggctgtttggtgatggtttggaattgtgtgaggtcatatatataggggaggtgctgtccgtttcatcgtaaaatagattggggtcgatacataatagttatgacgctcaaatgataacgatagtatcgtttctcttattgtagactaaggagttgtgacaatttcatagattgagattggggcagtatatataaggtatgtgaggctattcccttccttcttttgcacgactctgattgtacacaatgcaaagaacaagcttcaaaggatactctactcttagaagctagcagtacttacgttgtttgccctcttatggaacgattgatgttaatgttgcttctcttatccttatgttattaatgttgttggtacttcctgattcttataaggttcataatgaagagttagtcctaataatgtgtacaaaggataccgaccttacgtcactcctaaaggtttagaacgtgattccatgagtcgagcatgcattatatatatgtatctattttactctaccgagccgcgctatagacggtcgggtatggcacctattgtgcaaccactgatcagttgggtttaacgagctccacgtggccgggtacgattctaccgagccttatgatggccgggttcgtttttaccgagcctattatggccgggtacgatatgatgatgatgatgcccacagaggcgaatgttttaaaagtttatatatttatgcatatgtatcatgcatttcatgtcagtagccctcagaggtactcagatgttacaggttgtatattctctatccctgcttacattactgatcgtatttatagttccctgccttacatactcagtactttattcgtactgacgtccttttatttgtggacgctgcatgtcgtgctgcaggtcctgatagacaggcaggtgcagctcccccaccacagtaggctgtccagttcagcggtgattggcgagatcccttctccggacttgccttggtcttggtatgcatttttgttatagacattatgggtatgtcggggccctgttccggctatgttgcagtacttatattcctttagaggctcatagacagatgtcgactcatgtatagtttggtatgccttgtcggctagtttttgttgtatagtctttcatgttagcgtggtagctcgcaccttatatatagtttcttgattgtctggtcatcccatattatgtatgttcatgccatcatattttattgttggttgtccatgatccatgtctgccatttatattgatctcgtcagccgtaaaggataataaagaaggttagataaaatgtacgttggtgctcggcaagtatggtcgggtgctagtcatggccctccagtttgggtcgtgacaaacttggtatcagagcaagtctgtcctaggggttgtctgtgagccgtgtctagtagagtcttgattatggatgtgtagcgcgccacatttataatcaggaggctacatgacatctagggttgttaccttcttcctgaatctagatcgtgcgtagagttgagtcgtaagtgttcgtctctaatattaaccttgttttctttcagcaatgccttcgactaggaagcaaacaattagtagacggcttgatacatcagcagaagagggtaccagtcaggtgccccaagttagagcaggccaaagtgaggcttagagtgagatcccctctcatacctcatctactccgtctcctccagaggatattaggaggaacccagtacctccagttcttccgctagcactacagaccaggatatgcgaagttctttgcagttattgactagcttggtagctgctcaggcttagaggcagaatacatgtgctgctgataaaccagttagtacgagagttcgtgattttattaatttagaccctccagtatttatcggatcagaccccaaggaggacccacagacttttattgaccaggttcatcgtacactacgggttatgcatgttagtgatacagaggcagtagagttgacttcttatcggctacgtgatttagcagttctctggtatgatagttgggagagatccaggggtccgaacgctcctccagctgtgtggaaggaattttatgaggcctttcttcgtcactacttgccagttgagatacgacgagctagggctgataagttcttgaaccttagacaaggtaatatgaatgtgcgagagtacagtatgcaggttgattctttagcaaggtatgctccccatatggtggccgagatgagtgatagggtgcatttgtttgtgaactggttgggaccacatctgataaatgagtgcacgacagcctccttggtggagggcatggatatttcccgtattcaggcttatgcccagaccctagaggatcgtaagcaccaacagagggtagatagggagcaggataggggccaacataagagggcgagatttgtagggtattctgataacttcagaggcaacgtcaggccgcagtcttcgaggagttcggcgccacctgtagctagtgctcctccacagtttcagaggcctcgatatgatcgatcctattctggtccaagtcagagttcgcgggcatctggctcgcaacatcacagggatactagtcagatgagacccccaacaccacgttgtgatcagtacggcaaggcccactttggactgtgccgtcgaggttctgatgcgtgctattcgtgcggacagcctggccatatgatgcgagattgtcctaacagaggaggtgatggtatggctcaaccgactggatctgcgtctggttcttcctcatcagttcgacctccagcacggggttttcagcagtcaacaggtcgtggtagaggtagaggtgcagtaccgagtttgagtggtgctcaaaatcgaacctatgctctagtaggtcgacagggtctcgagtcatctccagatgttgttataggtatattgtctgtgttttcttatgatgtatatgcgctaattgatccgggatctacattatcatatgttacaccatttgtggctaataagtttggcattgaacctgaattgataagtaaacccctgtggtatctactccgataggagattctgtgattgctataagggtatatagaggttgcactgtgatgatttgtagtcgtcaaacctcggcaaatttatttgagttagaaatggttgattttgatatgataatgggaatggactggttggcctcatgctatgcaaatgttgactgtcgtacgaagatggttaggtttcaatttcctggtgaacctgtcattgaatggaaggggaatattgctacaccgaaaggtaggtttatttcctatcttaaggcaaggaaaatgatctcaaaaggctacatttatcatctcgttcacgttagggatgcagaggcgaagccgcctactttacaatcaatccccgtggtcaatgaatttcgagatgttttcccagatgaacttccaggccttcctcctgaaagggagattgagtttagcattgatgtgttgcttgacactcaaccgatctctatccctccatatagaatggccccggcagagttgcgagagttgaaggcacagttgaaggacttgctggataagggcttcattaggcctaacacttcaccttggggtgcgccagtcctattcgtgcggaagaaagacgggtcgttacggatgtgtatcgactatcgacagttgaataagtttactataaagaacaagtatccacttccaagaattgatgacctgtttgaccaactccagggtgccaagtgtttttccaagattgacttacgttcagggtatcatcaggtgagggttaaggagaaggatattccaaagacggctttgcggacaagatatgggcactttgagttcttggtgatgtcgttcgggctaacaaatgcaccagctgcttttatggatctcatgaatactgtactcaggccctatcttgatgtgttcgtgatcgtattcattgatgacattctggtatattcccgttcggaggcgaaacatgcgggccacttgcggatagtattacagacgcttcaggatcgtaagttatatgctaagctctccaaatgtgaattctggctgaattcagtagcattccttggccatgtgatatctgacgagggtattagtgtcgacactcaaaagatcgatgcagtaaagaattggccgagacctacaacaccatcagaagtccgcagcttcctagggctagcaggatattataggcgatttgtagaagggttttcctctatatcagcaccattgactaagttaacacagaaagctaccaagttccagtggtctgacacttgtgaacgtagttttcaggagctgaagaattgattgacatccgcaccggtgctcactcttcttgaaggtacagaaggttacgtggtatattgtgatgcctcgggtatagctttgggctgcttattgatgcagcatgggaaggtgattgcttacgcatcaagacaattgaagaagcatgaaaagaattatccaacccatgatttggaattggctgcagtaatatatgctttgaagatatggcggcactacttatacggtgtccatgttgacatctacacagatcacaagagtttacaatacatcttcaaacaaaaagagttgaatttgaggcagcgtaggtggcttgaattactgaaagactacgacgtcgagatattgtatcatcccggtaaagccaatgttgtggcagacgctctcagccgtaagtcaatgggaagcttagtacatattgaggcagatagatgggggttgactaaagagctccatcagctagcccatatgagaatcagattgttagactctgatgacggaggtgttattgtacataataaatcagaatcatctttggtagccgaggtaaaagcacggcaatatgaagatcatatcttagtacgattgaaagagagcattcaacagtgtaaaattatggcttttgagatcggaggagatggggcactgagataccagggccgattatgtgtgcctaatgtggcaggattgcgagagaagattatgaataaggttcatcaatcccgatattccatccatcctggctcgacaaagatgtatcatgatgtcaaggagcagtattggcgggataacatgaagaagtctattgcagaatttgtagcccagtgtcccaattgtcaacaagtaaagatagaacatcagaaacccagtggattgcttcaaaatatagagattccgacctggaaatgggaggtgattaatatggacttcgttattggattacctcgctcttatcataagtttgactccatctgggtgattgttgatcgacttacaaaatgttcccattttctgccagttaggacaacttacacggctgaagattatgcgaagttgtatatcaaggagattgttaggcttcatggtgtgccgatatctattatatcagaccgaggagctcaatttacggctaacttttggaggtcttttcaaaagggcttaggcacacaagtgaatcttagcactgcatttcattcgcaaacagacggacaggctgaatgtaccattcagacactgaaagatattctacgagcatgtgttctagattttaaggggaattgggatgaccatcttccactcatagaattcgcctacaataatagctaccattccagtattaaaatggccccatacgaagcactatacgggaggcgatgtagatcaccagttggatagttcgaagtcggtgaaatagaattatatgggccagatttgattcaccaagccattgagaaggtgaaagtgatacaggagcgattgaggacagcacaaagcaggcaaaagtcttattctgatgtccgacgtcgtgatttggagtttgaggttggtgattgggttttcctgaggatctcaccaatgaagggtgttatgcgttttgggaagaaaggtaagctgattccaaggtatatcgggccgtataaaattcttcgacgaattggacatgttgcttatgagttagaattgccatccgaattggaatttgtccacccggtattccatgtatctatgttgaggaaatgtattggagacccttctcgagtcgtccctataaaagatgtacaagttacagaggacctatcatatgaataagtgccagtggctatattagatcgacaagtccgcaagctaagaacaaaagatgtagcttccgtcaaagtattgtggaggaacaagaatatggaagaaatgacatgggaagcggaagaggagatgaagtctaaatacccttacctattccagaatgaagataacaaggatgctggtggaacacaaaatatattggaaggtggaacagctctatgaggtaagcaataacttgagaataatcttccttaataaaaatggtgatatgcagataatgtacatgtccataaagttttgcatactcttgtaatcccatacgttcagttaactgcttgcaagttcgtcctctatttatgggagaaactcggccggaatccacgatgatttaaactccccatgagcccgtacattcgaggacgaatgttcctaagggggggggggagggtgttacaacccatatccacacacgttagttcattccatatattagttaacatatatccaagaaggaattatcctttagatgataagaagttaatcatattggtcttaagtaatacaagggtgtataagggtgattaacaagtattagacgttaaacgaatcaaggatgttataactcataatttcaggtaaacctagaggtgcttaatacactcaagaggtcatgtattaaggtatatgaatcatataatatccgtatcataagccttgaagtcaaacgagttatgaaacaaaagtcgacaaaagttgtcgcaacttaggttcatagttttgcttaaactttaggtcaaatgttgttaagcttttctcccaatgtacttggaattaaagggtgatatacccaccaaattgaatatctatgagtctagtttctaacgcattaaaccgttcgtcgatacgatctcggagtagagagatattcgcgttttcgcgagactgcgccaagcacctctccatggggcccactaaggcggtttgagatatttggacctatataggatgcctccaaccagtttttagtcatttattttcactattttcagaacttagaaccctaggaactccctctcaagtttctctcaagattcaagacccaaacaaagggcaaacaacacaaatcaagtgtcgggaatcccgtggcgctagtaagtctcttattcttcttgttgttgctcatttttgtgatgttccagctcgtgtgggaggttgttttaaagggtttaggttctgtaaatactccctcatgttcttaatatcaatcctaggtgatttcaagccttctaaagtgattctagtgccaaaaaacactaattgatcgctagtttcgcttttttgttgttgtggcagcattggagggatatttcatggaaacttaaggtcaaattggagttgttctttctgtataaaggtaaggaacctcttaccctatatgtatttaagattatccaagttgcggctaagccattgaagctagaacttgtgaaatatatatcgaaaggtttggtagtaatgttatcggttggtggactattttgggaggctcaatttgattattattgatgttgtttgggctgtttggtgatggtttggaattgtttgaggtcatatatataggggaggtgttgtccgtttcatcgtaaaatagattggggccgatacataatagttatgacgctcaaatgataacgatagtatcgtttctcttattgtagactaaggaggtctgacaattgcatagcttgagattggggcagtatatataaggtatgtgaggctattcccttccttcttttgcacgactctgactgtacacaatgcaaggaacgagcttcaaaagatacactactcttagaagctagcagtacttacgttgtttgccctcttatggaacgattgatgtcaatgttgcttctcttatccttatgttattaataatgttggtacttcctgattcttataaggttcatagtgaatagttagtcctaataacgtgtacaaaggataccgaccttacgtcactcctaaaggtttagaacgtgattccatgagtcgagcatgcattatatatatatgtatctattttactctactgagccgtgctatagatggccgggtatggcacctattatgcaaccactgatcagttgggtttaccgagctccacgtggccgggtacgattctaccgagccttatgatggtcgggtacgtttttaccgagcctattacggccgggtacgatatgatgatgatgatgcccacagaggcgaatgttttaaaagtttatatatttatgcatatgtatcatgcatttcatgtcagtagccctcagaggtactcagatgttacaggttgtatattctctatccctgcttacattactgatcgtatttatggttccctgccttacatactcagtactttattcgtactgacgtccttttatttatggacgctgcatgtcgtgctgcaggtcctgatagacaggcaggtgcagctccccgaccatagtaggctgtccagttcagcggtgattggcgagatcccttctccggacttgccttggtcttggtatgcatttttgttatagacattatgggtatgtcggggccctgttccggctatgtcgcagtacttatgttcctttagaggctcatagacatatgtcgactcatgtatagtttggtatgccttgtcggctagtttttgttgtatagtctttcatgttagcatggtagctcgcaccttatatatagtttcttgattgtctggtcatcccatattatgtatgttcatgccatcagattttattgttggttgtccatgatccatgtctaccatttatattgatctcgtcagccgtaaaggataataaagaaggttagataaaatgtacgttggtgctcggcaagtatggtcaggtgctagtcatggccctccagtttgggtcgtgacataaaggctcagtttatggttgaaaagggatgtttggcgtatgttcgtgattctagtgctgaggttccttctatggattttgtgcccgttgttcgtgagtttccagaggtatttccttcagacttgccgaggatgccacccgatagggatattgacatttgcattgatttggctccgagcaatcagcccatttctatcccgccatatcgtatggccccgtcagagttgaaagaattgaaagaacagttgcaggactttcttgataaaggctttattagacatagtgtctcgccttagggtgcgttggtgttgtttgttaagaagaaggacgcatcgatgaggatgtgcatagactatcggcagttgaacaaggtcgcaatcaataataagtatccattgccgaggattaatgatttgtttgatcagcttcagggtgccaaagtattttcaaagattgattttagatctggctaccatcagttgaggattagggcatctgatgtccctaagacagcttttcgcactcggtaaaggcattatgagttcttagtgatgtcatttggattgacaaatgccccagcagcttttatggatttgatgaaccgagtgttcaagccttatttggattccttcgtgattgtcttcattgatgatattttgatctattcccgtagtcgggaggagcatgagcagcatcttcgagtcgttctgaagactctgaggtacagtcaattatatgctaagtttttgaaatgtgcgttttggttgagttcagtagcattcttgggttatgttgtatccgtagagggtattcaggtggatcctgagaatattgaggcagtcaaagactggcctagacccgcataagctatagagattcggagtttcttgggtttggcgggctattaccgtcggtttgtggaggggttttcatctattgtatccccgatgaccaggatgacctagaagggtgcccagttcaggtggtcggacgagtgtgaggcgagctttcagaagttgaagatacatttgtcaaccgcactggtgttggtatttcctacaggttcagggacatatatagtgtattgtgatgcatctcgtattggacttggtgcagtgttgatgcaaaatagtaaggttattgcatatgcttcacgacaattgaagatccacgagaagaattatccagttcatgatttggagctagcagccgttgttcacgcgctgaagatttggaggcattatttatatggcgtgtcatgtgaggtattcacagatcacaagagtttgcaatacttgttcaagtagaaggagctaaatttgaggcaaaggaggtggttagagctattgaaagactatgatatcgccatcttgtatcatctggggaaggccaatgtagtgtccaatgttttgagtaggaagtcagcaagtatgggcagtcttgcgtatattccggtcggtgagagaccgcttgctttggatgttcaggctttagccaatcagttcataaagttggatgtttctaagcccagccgtgtgctagcttgcacagttgctcgttcttcattaattgagcgtatctgagatcgacagtattatgatcctcatttgcttgtccttagagatatagtgcggcacggaagtgccaagcaggttacagttggagatgatggagttttgaggatgcaggttcgtatttgtgtgcctaatgtggatggacttcgtgagttgattctagaggaggcccatagttccccgattctattcattcgagcatcactaagatgtatcaggacttgcggcagcattactagtagaggagaatgaagaaggacattgttacttataaagctcggtgtttgaattgtcagcaagtgaagtacaagcatcagatacctagtggtttatttcagaagattgagattcctaagtggaagtgaaagtgtatcgctatggattttgttgttggactttcacggactcagaggaagtttgacgcagtgtgggttattattgatagacagactaagtcagcgcatttcattcctgtggcagtttcctattcttctgagcggttggtagagatttatattcgggagattgttcgtcttaatggtgtgcccatttctattatttttgaccgaggtacgtagtttaccttgcatttctagaggataattccgcatgagttgggtactagggtcgagttgagaacaacatttcatactcagacggacggacagtccgagcgtactattcagattttggaggatatgctccaagcatgtgttattgactttagagtttcatgggataagttctttccattagcagagttttcctacaacaacatttatcagtcgagcatccagatggctccctataaggcattatatggtaggcggtgattggatggattaagccggtagagcctcggttgttgggtacagatctagtataggatgccctggataaggttaagatcattcataataggcttcgtacagcttagtccaggcaaaagagttacgtcgacagcatggttcgtgatgtggcactcatggttggagagtgagtgttgcttcaggtgacacccatgaagggcgtgatgagattttggaagaagggcaagccaagccctaggtttattggtctttttgagattcttgatctagtgggagaggtggcttacagacttgcgttgctgccgagtttatcagctgtgcatgtgtccatgtttcgaaagtatcatgctgatccatcccacgtgttagtcttcagcactgtcctgttagacaaggacctgacctatgaggaggagctggcagtcatactagactgacaggttcatcagttgaggtcgaagaatttcccttcagtttgtgtgcagtggagaggtcatactgttgaggcagcgacctgggagtccaagtccgatatgcggagccgttatcctcatcttttcaccgactcaggtacttctttatgtcggttcaagtacgaacgattgttttagaggtggagaatgtgatgaccctaaaggtcatctcctgttttagaagtcaaaactgcgttccgaggccttaaatacctctttttgtctcaccctcgatttgtgtgtgcagtccgcgcgcatttctagaaggcttttatgtgaagttttagaaaataatgaatttggcctttaaaatgggttaatggtgactttggtcaatattctcggtaaacagacccatacccgtgatcgaactgtcccgtagggtccgtggtaaaatatgaaacttgggcatatgcctggaaccgaattcggaggtcccaagcctgagaaaagaatttttaaataaaattatttgctggaaaatataaaggctttttgaatttaaatgatgtgtgttcttgatggtatcgggctcgtattttggttccgaaactcggtactggtttaaaataataattaagtttaatatgtgaaatttgctaagaatcagagctgatttggtataaatcggacctatagttgagaaaatgaaaatttcaatgttcttgggtaatttcatgaatttgaggttaaattcgtagttgttgatattattttgatgatttgatcgcacaagcaagtctgtatggtgtttttaaacttttgtgcatgtttggtttggagccccgaggactcgggtgagttttggataggccacggtgtgaatttggacttagagagattgctggtatgttgcaactgtgtaacagggctctgatctctcaattgtgagattaagcttcgtaaatgcgaagtgctcaggcttgggaaatgtgacaccagtgtcgcaaatgcaaaccaagcctgggcaggccctgttcccaaacatgaacactgggctgggaattgcgaagcccatcgcaaatgcgacattttcctttgcaatttcgaaaatgacaggattccaaagggatcgcaattgcgaacccctggtcgcaattgcgacatttgagacctgttatgtgagatttttgccaaggttcttttctatttttacaacttttgaaaccctaaactccaatagacgattttcttgaagagagttcttccgcaaatcataggtaaatgatttctaacttattttgttcaatgtaaacatctttttacatgatttcattttaaaaatcaagggttttcatgggaaattgggtgtttatgggtataagttaggattttcaaattttgggtatttggaccttaatttgaggtccaattttaaaattaactatatatttgagttcgtgagtgaataggtgatcagatttggttagaacctcagattttgaccaagcgggtccggggttaatttttgaattttttggaaaacaatggaaaacctattttcatgcattagaattggtctatttagcatttattaatgttattaagtaaattgtgactagatacaagtgaattggatgtggaaccgagaggttgttgaggcttaatcttgttcgtgaatttgaggtaagtgtttggcctaaccttagcttgagggaataagagttgtgatctatttgctatgtgtttgtatcgagtacgacatataggtgtggtgacgagtacatatacgttggtgtcaagcatgtcagtgagtcttttatcatgattttgtgactctaatatgtatcgatcatactcaatttgatgattattaatgttggacaaagcttatgaaattttcgtggtaattgattattgttgagaattggcacaagttgagtttcagcgttgtaaagtaattgttgaaaacgagattggttatggatgaatcccttgccgagatgttattgttgatatcgttgattccctttccaggatattattgttgatattattgtttcccttgccgggacgtattgtttctgttgtttgggtgaggaagagtgtcaaacacgaagggtgatatcgtgcatgatattgtgaatgagtgtaatgcacgaagggtgatgcagtatcgatattatgagtgctaatgcacgaaagataatgtcgtgccatgatttgaaagttaatgcacgaagggtgatgccgtaccaatattataaggaataatgcatgaagggtgatgccgtaccaatattataaggaataatgcacgaagggtgatgccgtgccatgattatgtgaggtaatgcacgagtgatttcgtgccgtatcatatggtgaggacgagagtaaaagtacgaagggtgatgacgtgcacgttttaccgtttcatttatcttattgatatggatatgatgttcattatacttctttacagatgtttctatattggtttactgctataatctgatattccccgcagcatgtccccttcccaccttattgtgttgattcttgttattatgtttctgttggtatatgttttaactgtacaggtttatatggttgtcgtgttctagcctcgtcactgcttcgctgaggttaggctcgacacttaccactacatggggtcggttgtacggatactacactctgcactcttttgtgcagatttcggtaccggacccagcgagtagctaaggtagctgccttcagtccaaggagaccaaggtagatctgctgacgtcgcagagcctgaagtcccccttccccgttttagctttccgctatcttttttctttccgagaacaattgtattttcttttcagaccagtatttgtagtaattcgcgatgttcgtgaagttgtgacaccagatccgagggtagacttgtattggactatttgatcatgttataactcttccgcatttatcatatgtttaacattagtttctgtttataattgtttgggattgattgttaaatgtgtagaaccttaatagttagtttgcctagcttttgtgagtaggcgctatcacgaatcccgaggttgagaaatccgggtcgtgacaaacccagtataacattaattcctattaacgcataacacttcccatattcttatgcactatagaataaggattaatcgtccccttaatgacatatttactagagttttaaacttattattcgaccaatcattacaaataaaatattgaaaacgctaagcacactacaaattggaacttaccagctgtggcgaaagcataaggttttcaccaaaaaaattaaaaaacaaacgcggaaagaagttaaaggattcaatacctaatatatatatacatgaaaaaaattaaccttatagatatattgtaaatttcatcaaaaataattcggctaaacccccttccgtccaactagctctatccctgcttatcagggaatttaacatggatttcttatatattcttattgtggtattttatttaataaagaaaaaaaatgaaaataatgtttttcttggtagattgagcagtaatgggggtggttgggtggctggtgtgattaatacatttttgtgaaaggcaaatctaagaagactttatcaactcaattgataagtgaccttttgacattatccactcgcattattaataagtgaactaataagtcagtcgtgcttttaattcgtcggcaatcaattatgtacgtggcatttagaagctgtcagactatttcaattattggattcataattaaatatttacacttatactaacatgcaaaaattatttacactgtataaaaattatttgtataagcaagtcacttaaagggagtaattaaatgttatatagagaaaatgacaactaacaaacaggggcgtatgcaggaatttttgtaagcggtgtcgaaatttatagaagaattagaatattactttgattatcatacttttagacaagaaataatcttaatttattggttttgttgagtcttaaattaaaaaagattttgagtacaattctacttcatcacaatttttaactacaaaggctctctcaaatatttacaaaagaaaaatgtgctagttgaggtttgaacctttgacctcttagagcaaaatcaagcacaaaaacaacataccaagacataatttatgtcaagtggtgtccttttttcttacttatccgttttcgtacaatattaatacatatatttagtaaaattttccgacgtagcagtgtcgtatgacaccgcttgaggaagcgtgcatccgcccctgctaacaaatatcgcaccatataaaattatgtagacagctttcaaaattatcacaatatcggagtatataatttaaatcttttctagctagatatgtcaggatacggttgtgggaattgaaccagcaacctcagaaagatttgaccactgaactatgctttcgggctgtaacaaggggattcaaaatataatatatagaaacgttaaataaattttatcttatatgtacattacataatactccagtgaacaagattcagatgaattccttccgctcctaaattcgcccatgccaacaagttgataaaatttagtatttctagctagtagtttattgcatgataatccgataataatatatcaacatttaatgtacggttttccccacatgatgtgtccaaaattttaaaggaatttagaaactggtggtaaactattaatggataatatatgaatccaaagaaataccgttgagaaatgttttgcggtcgagatcttaaaaatcaccttgaaatggtttaattacgtttacgtcttgttgttccattttatatgatactatttctttattagttcgtttaaaaaagagcgataattttttgtatttaagaataatttaacattaaattttatatttttccttaataacacgtatttaatgttacagaaatctatcgcatatatatttaagaagacaagttcaaaaaattgttatatttttttcttaaattttacgtctgatcaaactacaccacataaattgaatactccatcctctattgtgcaggggtttctcatcttgcacattttcgaaatacaaacgtaacctactaatttctttataagaatttgcaaatttttcacgacttaataaatactagtagtggttaattattcgtcattacatgtcagtttaacctgataatgcaaaaaatatataggtggttacagggctggtgtagcactatagtaacgcatttaattgaactcataactttcaatatggagtacaaatttatgtgaaaaaattcactgaaattgaaataaattgtatatatgaacctataactttataacgatataatgagttcaaaactaagaaccttaaaagttgaatctgtagaatatttaaatcctggatccacttctgcactgttatggtatactccctctgtctcataatacgtgtcgtgattctcttgtgcacaccccttaagaacaaatagtactttttgactactttacccttattaaatattttctcaatttatgtgtcatctccataagtaatatgtttgtagtcttctaagataagtactccatctgtctcataatataggtcgtgattctcttgtgcataccccttaagaaagaataatttttgactactttacccttattaaatatttttttgaatatatgtgtcatctccataagtaatctgtttgtagccttctaatataattaattattattaagggtaagaaaggaaaaatataatcaattttgtcttgaacttctaaaatgtcaaataatttgagataactatttttagtaaccacgacacacatattataagacggagggagtaagaattatgtaaatatctttttagaactcaaatgtgaactcttcactctcctcacctgccaactgaatattggtcccctcagaaattaatacccttctattcaatcagtcatgtactcaaattttactataaatagagcccaatattgcatcaatttctccatccttcaatttcaagtaacattactaaactttgacaaaagatgggttacaagtcatttctgtttcttggcctttttctggccatttttgtaatgataagctctgaggttttagctagggagttgtctgagacttctaccacttcagcagaggaatgtaagaatcctctcattatttgcatatatgttcaattctctacttaatttttgtcctatttttaatctagtgaaattaattaacattttaaattagtgtttaacgtgtcataatgatattatttaaatcccattagaacaagtacgtacttaaattatagtttgaaattattgtatatttactaagttgtataattactaggataataataacacgatacattaattacaagtgtattcgtaaatatgttacatgttgtctttactatattagcttgaccaagactcttttggttcgtttggcatgagagataagggataattaatctcgggattaaatttgagataagtttatttcacatttttgggataaaatcgcagtataactgatcccgcgattagttattccggaattatagcattatttttatccctacgagagagtgggataacaatcctgaaataactaattctgggataacttgtttccaaccaaacgatcctcttaccgtacgtaattacgcatgtatcatgaaagaatacataagtaaaaaccccattatttttacattttaatttgcatatacaaattctaaaccttctaaaatataatcataaatcttacaaactttatcgattacatattttctagttctgtgttaggatcacataataataagctaaaagggaagaagaataaaacagttaagaacaacattctaattttcacaattgatgcagcaaagaaatccaatagcaagaatgaagtacatgaagctcaataccctggcggcggaggataccctggcggcggataccctggcggtggtggtggataccctggtggcggatatcctggtggcggatatcctggtggcggatatcccggtggtggtggacgtggtggtggtggacgtggaggtggcggacgcggtggtggtggacgtggaggtggcggacgtggtggaggatactgccgctatggttgctgcggtcgccggaattattatggttgcagcaggtgctgctcctacaaaggtgaggcaatccatggataaggtcactgaagctgctttgacttgcaagatgtaatagtaataatcttgcagctttagagcttgttgtaccaagttatgaataaaattaagtcatcatttaatatttgtgttaattatacaatggtgtgataatgttttcccttttgagcatggtgttatctttttttaacgcgtaagggatttacttttatacataagagatctgtcttttacacataagagatctaaataagctattttcttaaattcaaaattgtaaaggggcatgatgtacaaattgcacgaaatattcgaagagaatgtaagaaaaaccattgtccataacaagagatgatttaattatcccttaatatgagatttttcataagaaaagaagcatccaacggatataacgaaggggatgaagatggttactggcaacctttagtatacgaaggagtaccagattactgcaaatactataaacaccagggacataaggaggaacaatgcagaattaaagcaagagacaactccaacattaatttagttgaaccaagagaaagacaaggcgaggatagagttaccaagcaaaaggaacaaaccaaaagtaaaggagaaagtagtcagcacatggctactaacaagagcatttcagtaaagaagcttaattaggctattcagcaaaattagatcaataacataatggtgaaccaacaacaacctaagaagattactaccatggggaaagaaattgcccaaggagaaagtagtacaacaatagctcatatgcagatcaatgccaaagcacaaaacaaagaaaaagtgaccaaacaaatctatataccaatcaatcaacttcgtgaactacagagacaacctactataagagcaactgagacaactaacaatgtgggggagaacaaggataacagaggaactaatactataacagaagttgtgaaggaaaagaatctccaagtgatgaacatgggagatgagttactagctagaacataacaaaatcctgaaaattagagacaacctacaacaattgcagccgagacagataatacaatgagcgagagaataaggaaaatggaagggctgattctgtaatagaagctgagaaagaaaagaatctccaggatccagaatcccctagcaacttccagatgatgaataggggagaagaactattggttagaacggaacaggttcacatggtcgaggagaagcagaacaatgatttacaactaattaccaactatgagagggattctgagaaagcacataatccagaaattgacaaaaacaagaaagggacaagtacaagtagtaatgtgatcgacaatatgaatcagaattccaccatcagtccagataaaggaacaaaccaaaagtaaaggagaaagtagtcagcacatggctactaacaagagcatttcagtaaagaagcttaattaggctattcagcaaaattagatcaataacataatggtgaaccaacaacaacctaagaagattactaccatggggaaagaaattgcccaaggagaaagtagtacaacaattgctcatatgcagatcaatgccaaagcataaaacaaagaaaaagtgaccaaacaaatctatataccaatcaatcaacttcgtgaactacagagacaacctactataagagcaactgagacaactaacaatgtgggggagaacaaggataacagaggaactaatactataacagaagttgtgaaggaaaagaatctccaagtgatgaacatgggagatgagttactagctagaacataacaaaatcctgaaaattagagacaacctacaacaattgcagccgagacagataatacaatgagcgagagaataaggaaaatggaagggctgattctgtaatagaagctgagaaagaaaagaatctccaggatccagaatcccctagcaacttccagatgatgaataggggagaagaactattggttagaacggagcaggttcacatggtcgaggagaagcagaacaatgatttacaactaattaccaactatgagagggattctgagaaagcacataatccagaaattgacaaaaacaagaaagggacaagtacaagtagtaatgtgatcgacaatatgaatcagaattccaccatcagtccagataactcatcttcttactccaacaactcatatcaaagtgctagagctagaaaaagggctaataagaagaaaaggatgctggaagttattaatgtgcaacatggaattccttctgaaccttggcaatctgcttgcaaagacaatgggaatatcaagggggaaggagtgaatgatgtgaaagattttaatctagttttcgagctatacgcgtaacaagtagcgtgtgatctgaattgtcaaatgaaactggtggatgaggaaactgatcaagagactgaatatgataatcatatgcaaatagcaactaaggagaatgatcaagaaatagaaaatgaggaaacggatagtgatagagaactatgaaattttaatgctagtccagaggaaactacagagatcctaattcagccttttggcatacggaagaaggtagatcaaggaatccaaacggaattggatagagtaatccagcagggacatctttctcctagatatttcaataacaaaaccaacaccaaaggaaaagatctcataaagggatcccaaaaagttcctaagaagaacttttaatgattaatatcctcaattgtaatattaaagagatgaaatcccaagcagcaacagaaagagttatctcactcatgcaaagttatagaatttctttcttggctcttcaggaactgtcacgacccaaatccgtaacgggccatgatggcacccaacaaccttgccgggcaagccaagtgcggaaaacaattaagagtttaacaacactaacatttaaaaaggggaataagcatcccaacaggggtttccagaacccgatagagcaataagtgtaaagataaaatattacaaacccaaaacatgtctactaagtgtacgtgccaagacctggtgtcacagtatacaggaaactagtagaaatatacaacatctaccctactgtctggaatgagggaaagacagcaaaatacagagaaagacttcatccggctgcagaacgatgaaggaatgagaagcagctcaccgtggaagtctcaactgctactcactggcatgcaccctggcggtatccagatgaatcagcgtcagaccctgtacatttaagtacagaagcgtagcatgagtacataaataacatgtacccagtaagtatcccgtctaatctcgaagaagtagagacgagaggtcgactcgatacttactaaggtcaaagtatataatgaaagtgatttacaataagcagttatatcacaaggtataaagcactaagcatggagcagaaattcttcctctttttacctttccataaagagagctcagtcatatatctataagagccaacaattagttcaaaaatctaatacacaagtagaagagcaacaatcatgtgcatatatccaccgaggaacgtacgacccgatccaacaggaaaataaatgtgcactgccgagggtcgaacggctcgaaccatagatgcatctattaccccgctcgcgtatcatccatgcgacgcagtcaacataaagtaaacatataccccgctcgcgaatcatccatgcgacgtggtcaacataatcatacatgctcaaataatcaagtaatgatgtccaagaggcatattcttccttttaacagtttagggcaaatattacttaatccctttataagtactcaccttaattcgagatgatccttagcaaattacatgccaacaagtttacaatttgttcacataaggcccaaaggtggcaccaataacatagatatcacgtaaagcatgctcatggtcctaaactacccggactttagcatataagtcactacgtacggactctcgtcacctagtacgtacgtagtccccgcatacaaagcaagtcttatttaattattaagtcatatggggacaatttcctcctacaaggttagaaaggagactcacctcgctccaaaccgcacttccaaatagcaagcacaagcccgagacctcaaaacgaagccgaaagcgcacaaacttgccaaacaaaataggaactagtcaataagggcttacaaggttgatttgtaactattgaagtgatttcctaaccttttccgcaagttttctatattccgaccccgggcccacgtgtccggattccgagatttctcgaaggaaaatatcctctatagcctaaggattactaatatgtgatttttagttcattacaacgctaattaggtgattagatcgtggttttatcaaaatcctaggcctagctctaacccttgattttattgattattagtgtttaaatctatgtcataatcatgtatttaagctaagaatgagtggaaattacttaccttgtgaagatgtgtgaaaacctctcttggaaagccccaaaatcgcccaagggatgagaaaatgtgagagaaaaggggttggagttcatcttaaatgaactcactgccccccagcggtttccgcttctgcggtcgcttttctgcttaagcggtgaccgcttatgcggtcgaggggccgcttgtgcggtttggggaatcactgggcggaccgcttctgcggtcatgcgtccgcataggcgggaccgcttctgcggtcccagaggtcgcctctgcggttccccttcccttttcccttttcgcttttgcgctgcatagaccgcatctgcggtcgccgcttctgcagtcaagatgccgcagaagcggttatgacaggagcagcacatgaggttttcttcaagtttcgacttccctcaaacctcgaccatttgacgctcggggctcccgagcccagcccgaacataccgacaagtctgaaatcacgaggcggacctaggcgaaccctcaaaattctcaaagcaacgctaaatcaagggatcgaaccccaaaaccaattgatcaaacttaatgaacttcaagttcttaatttcctaccaatgggtcaaaacgaccttatactattcggattgacgccaaactttacgggtaggtcttatatgatatttcggacttgtaccaagtttcggaaccggaatccgaacccgatacctaggtttttaataattaattggattctttaattctttgaacctttagattaacaattttacataaaaattcattactcgggctagggacctcggaattcgattccgggcatacgcccgggtcccatattttcccacggacctcccgggaccatcaaatcacgaatccgggtcagtttcccaagaaggttgaccgaagtcaaatctaactttttaaagaaaaccttaaggaacatttggttattttcttatccaaagctcttctaactcccgaactagtcactcccgcaagtcacaatcaagctaaggaaggtacgtggagttttatttaaggggacggggtcccaaacaataaaacgaccattcatgtcgttacaatctccccctcttaaacaaacgttcgtcctcgaacgaacatagaaaagtacctgaactgctgaacaagtgaggatatctgccccgcatgtcctcctcggactcccatgtcgcctcctcaaccggttggcccctccactggacccttaccgcagaaatcctcttggatctcaactggcgatcctgcctgtctacaatggcaactggatcttcctcatagcccaagttctcatctagctgaatggtaccgaaatccaatacatgtgataagtcggcatgatacttccggagcatcgacacatggaagactggatgaactcctgataaactgcgagactttcaagagaaccttctcgccaatcataaatgatacatcacgcgccttctgatccgcgtaactcttctgtctcgactgagctgctcgaagcctctcctggatgaacttcactttatccaccgcatcctgtaccagatccgtaccaagtaacttagcctccccaggcttgaactacccaataggagaacgacaacgtcgaccatacaaagcctcataaggagccatctcaatgctggcctgataactgttgttgtatgcaaactccgctaggggcaagaactggtcccaatgacctccaaaatcaataacacatgccctaagcatgtcctccaaaatctaaactgtccgctccgactgcccgtcggtctgaggatgaaatgctgtgctaaaatgaacattggtgcctaacccactctgaacggctctccaaaaatgggaagtgaactaagggccccggtctgatataatagaaaccggtacaccatgcaaccggactatctcccgaatataaatctgagcatacctatccgttgtataggtagtcgccactggaatgaaatgagcagacttggtcaaccggtctacaataacccaaactgaatcgaccttccgcaaagtctgcggtaacccaaccacaaagtccatagtgatgcgctcccacttccactccggaataggcatctgctgaaataggccacctggcctctggtgctcatacttgacctgctggaaattcagacatctggctacatactctacaatatccttcttcatccttcgccaccagtaatgctgcttcaagtcacgatacatcttcgtggcactcggatgaatgaagtacctcgaactgtgggcctcctcctcaagccatccacgtcaggaacacatatacggccctgaagccgtaacacaccatcctcgccaatagtgacctctttggctcctccctgaagtactgtctccctgagggctgccagatgcagatcatcgaactgccgggccttaatctgccccaataacgaagactgagccaccacacatgctagaactctgctgggctccgaaatatccaatctcacaagtctgttagccaaggactgaatgtccaaggccaatggtctctcctcagcaggaatgaatgccaagctacccatgctctccgcctttctgctcaaggcatccgcgactacattcgccttgactggatgataaagaatggtaatgtcatagtccttcagtaactcaagccacctgcgctgcctcaaattaaggtccctctgcttgaacaggtgctgcaaactacgatgatcggtgtaaacctcacacgacaccccatacaaataatgcctccatatcttaagagcatgaacaatcgctgccaactctagatcatgcactggatagttcttctcatgaatcttcaactgacgtgaagcatatgcaataactcgcccctcctgcatcaacacacatcccaagccaacgcgagaagcgtcgcaatatacagtatacatccctgatccggaaggcaatacaagaaccggtgcggtagtcaaagccgtcttgagcttctggaagctctcctcgcactcatcggaccaatggaatggaacactcttctgagtcaatctagtcaagggtgaagcaatagatgaaaagccctgcacaaatcaccggtagtaacctgctaaccccaggaaactcctgatctcggtcactgaagtaggacgaggccaactctgaactgcctcgatcttctgaggatccaccttaataccatctcctgacacaatatgccccaagaaagccaccgactcaagccagaactcgcacttggagaacttagcatatagcttctgttcccgcaaggtctgaagcactactctcaaatgctgcttgtgctcccccaagctacacgagtatatcaagatgtcatcaattaagacaatgacaaaagaatcaataaaaggcctgaataccctgttcatcaagtccataaacgccgctagagcattcgtcaacccaaaggacatcactaaaaactcatagtggccatatctagtcctgaatgccgtcttcggaacatctgaatcccgaatcttcaactgatgataccctgacctcaagtcgatcttagagaacaccctagcaccctgcagctggtcaaacaaatcatcaatgcgcggcaacgggtactagttcttaatggttactcggttcaactggcggtaatcaatgcacatccgcatagtcccatctttcttcttcacaaataacactggtgcaccccaaggcgatacactaggcctgacaaatcccttggccaataactcctccaactgctccttcaactccttcagctccttaggagccatacggtacgggggaatagatataggctgagtgcctggagccaaatcaatgcagaaatcaatatcacgattcagaggcatgcttggaagatcagaaggaaaaacatcggcaaactctcgaaccactggcactgaatcgatcgttggagaccctgctgtggtgtctcgaacatgtgctaaataatccaaacaccctttctcaaccatgcgccgatccttcagaaaagaaataactttgctaggcgtatcagccgtggagcccttccactccaatctaggcaatcctggcattgctagagaaatagtcttgacatgacaatcaaggacggcgtgatagggagataaccagtccatacccaagataacctcaaaatcgatcatattgagcaaaagaagatctgctctagtatcgtaaccacagaaagtaaccacacaagaccggtagatccggtccacaactacataatcaccaacaggagtggacacataaataggaacacccaagggcttaggagaagcaaccagaaaacgagcaaatagagaggacacatatgaataagtagatcttgggtcaaacagtaccgaagcactcctaccgctaactgaaatagtacctgtgatgatggcatctgaggccaatgcatctagcctggcctggagagcataaaatctggctggagtaccggctgtctggcctccacctgtctgagaagtagctggctgacctctccccatctggcccccacctctgggacgacctctaccttcctgccctccccttctaggtgcctgggccgctggtgctggaaccatggccagctgtccctgttgaatagccttgccccgaatcctggggcaagtcctcttcatatggcctagatccccacactcataacatcctctcggcaccatagcctgatgcccggaagcctgctgacctgaatacccgctggaagaccccctgaatggctggtgggcgatatgaactctctggcatggtgctgaactgagcactagaagacccctaataaccagaatacccactggaaggaccctgaatagctggtgggcgataagaactctcctgcatagcactgaaataaggcctcgctggagcacctcgtggaggaggtggtactggagctgaaactgggggcctactgggctgacccctccctgagtgacctctgcccctagctggggcgcctctaaaatctccagagaatctggacctcttctcctgctgcatctgctcaaaacccctctaacggtaaccctcgatcctacgagcaatctcaagggtcatctgataacctgtgcccatctctacctctcgagccatagtgtttctaatagtgggatgcaaccctgctacaaaccgccgtaccctctctgcctcagtggggagtatcataagtgcatggtgagataactcagagaatcttgcctcatagtcggtcactgacatctgaccctgctctaggtgctcgaactgataacgcagcctctccctctcagagggtggaatatacctgtccaagagcaactgagtgaactgaccccaagataggggaggagaatctgctggcctgcggagaacataagacttccaccacttgcgggccctgccctctaactggaaagtggtaaagtcaaccctatgcgactccaatatacccatgttgtgcagtctgtccctgcacctctcaataaagtcctggacatcctcctgaggttcgcccccaaagaccggagggcgaagtctagtccacctatccaatagcttttgcgggtctccgcccacagctggcatgacctggggtgccactgcagcaactggctgaaccccatccgcgggtagtgctcccggagtctgataaacggcagctgtgccacctggagcctgagcagtaggggtctgtgctccccctcctgcctgagaagtggcaggatccgctggaaataaaccagcctgagtcatagaatccatgaaccgaagcatacggcctataactgcctgaaagcccggtgctgtcataaaatcaaccggggcaggctcagctgcaggcaccttatcctgctcttcaataataggatctgctggaggaatgactggaatagctctggggcgcccttgtcccctacctcgggcaggtgccctcccccggcctctacctcggcctctaccaacagggggagcagctcctcccgggtcaggaacgtcagcagtacgagtcctcaccatctgtgagagaatagaaatggaaatttagcacaataaccactgcacgataggaagtgaataaagagtagtctttcctaataccatatagcccctcgaagataaatacagacgtctccgtaccgatctacaagactctattaggtttgcatgtaacattgtgagacctacgtgaacctagtggtctgataccatgttgtcacgaccccaatccgtaatgggacatgatggcacccaacaaccttgccgggcaagccaagtgcgaaaaacaattaagagtttaacaacactaacatttaaaaaggggaataagcatcccaacaggggtttccataacccgatagagcaataagtgtaaagataaaatattacaaacccaaaacatgtctactaagtgtacgtgccaagacctggtgtcacagtatacaggaaactagtagaaatatacaacatctaccctactgtctggaatgagggaaagacagcaaaatacagagaaagacttcatccggctgccgaataatgaaggaatgggaagcaactcaccgtggaagtctcaactgctactcactgtcgtgcaccctggcggtatctagatgaatcagcctcagaccctgtacatttaagtacagaaacgtagcatgagtacttaaacaacatgtacccagtaagtattccgtctaatctcgaaaaagtagagacgagaggtcgactcgatacttactaaggtcgaagtatataatgaaagtgatttaaaataagcagttatatcacaaggtataaagcactaagcatggagcagaaattcttcctctttttacctttccataaagagagctcaatcatatatctataagagccaacaattagttcaaaaatctaatacacaagtagaagagcaacaatcatgcgcaaatatccaccgaggaacgtacgacccgatccaacaggaaaataaatgtgcactgccgagggtcgaacggctcgaaccatagatgcatttattaccccgctcgcgtatcatccatgcgacgcggtcaacataaggtaaatatataccccgctcgcgaatcatccatgcgacacggtcaacataatcatacatgctcaaataatcaagtaatgatgtccaagaggcatattcttccttttaacagtttagggcaaatattacttaatccctttataagtactcaccttaattcgagatgatccttagcaaattacatgccaacaagtttacaatttgttcacacaaggcctaaaggtggcaccaataacatagatatcacgtaaagcatgctcatggtcctaaactacccggactttagcatataagtcactacgcacggactctcgtcacctagtacgtacgtagtccccgcatacaaagcaagtcttatttaattattaagtcctatggggacaattccctcgtacaaggttagaaaggagactcacctcgctccaaaccgcacttccgaatagcaagcacaagcccgagacctcaaaacgaagccgaaagcgcacaaactagccaaacaatataggaactagtcaataagggcttacaaagttgatttctaactattgaagtgatttcccaacctttcccgtaagttttctatattccgaccccgggcccacgtgtccggatttcgagatttctcgaaggaaaatatcctctatagcctaaggattactaatatgtgatttttagttcattacaacggtaattaggtgattagatcgtggttttatcaaaaccctaggcctagctctaacccttgattttattgattattagtgtttaaatctatgtgataatcatgtatttaagccaagagtgagtggaaattacttaccttgtgaagatgtgtgaaaacctctcttggaaagccccaaaatcgcccaagggatgagaaaatgtgagagaaaaggggttggagttcatcttaaatgaactcactgccccccagcggtttccgcttctgcggtcgcttttccgcttaagcgatgaccgcttatgcggtcgaggggcagcttttgtggtttgggaaatcactgggcggaccgcttctgcggtcatgcgtccgcataggcgggaccgcttctgcggtcccagaggtctcctctgcggttccccttcccttctccctttccgcttttgtgctgcatagaccgcaactgcggtcgcctcttctgcggtcaagatgccgcagaagcggttatgacaggagcagcacatgaggttttcttcaagtttcgacttcgctcaaacctcgaccatttgacgctcggggctcccgaggcccgcccgaacataccgagaagtctgaaatcacgaggaggacctagtcgaaccctcggaattctcaaagcaatgctaaatcaagggatcgaaccccaaaccaaattgatcaaacttaatgaacttcaagttcttaatttcctacaaccgggtcaaaatgaccttatactattcggattgacgccaaactttacgggtaggtcttatatgatatttcggacttgtaccaagtttcggaaccggaatccgaatccgatacccaggtttttaataattaattacattctttaattctttgaaactttagattaacaattttacataaaaatttattactcggtctagggacctcggaatttgattccgggcatatgcccgggtcccatattttcctacggacctcccgggaccgtcaaatcacgaatccgggtccatttcccaagaaggttgaccgaagtcaaatctaactttttaaagaaaaccttaaggaacatttggttattttcttatccaaagctcttttaactcccgaactagtcactcccgcaagtcacaatcaagctaagaaaggtacggggagttttatttaaggggacggggtcccaaacagtaaaacgaccattcaggtcgttacaggaaccatttgttggtgaatcaaatattagtaactacatcaggacctttgggatggctaactgcttctctaatagtaataacaaaatttggttgttctggagtcatgatatcatctgtgatattctggacaataaggatcaaatagtcaactgtagactatcccatattactattgatacaccagtgtacatctcaattgtttatgctaaatgcactggcgtcgaaagagaagacctatggaatgatatgagatattttgctactggagggacctacccttgggctgtttgtggagattttaattctatcactatgaaggaagaaaaaaagggaggaaaaccttttaacttaaggaagaaccttccttttatttcttgcatagatgattgcatgctaatggatgtaggtttcaatggtaacaattttacctggtgcaataataacaaaaaaagaagaagaagatttggaaaagattggacagactattagttaatagtgaatgggaggatatatttcctacatctacagtccagcatctagcaaaagtgagctcagatcatttccttttattgatacaatgtaagaaaaatgatgaagagcaccctaaatattttaggttcctggacttctggattgaacaaattggtttcaacgatattgtcaaagaagtatggagtacacactttgaaggcaatgctttatggaaagtgcaacaaaaactaaaaactgtcagcaaattattgagccaatggtctaagaatgttattggagatatatttgatattgctaaagtattggaaaagaagattggagaagaagataataaacttcaacaggatgacaatgagaacactagaatgcatttgaacaagctgaaggctgaatatatatactacatatgaagaaggttaactcgtattggaaacaaaagcgcacatcaagtggaatctgaatggagacaccaactctagatacttccataagctcatcaagggaagaagaaagagactttcctccacataattaagggagaagataatcaatggatagaaggagaagaagacatttcagaagctgccatagaatactatgagaagatgttttctcaaaaagctctaaggagtgaccttcagtttattgatcttattcctaaaataataactgaagaggacaataatagtttgataaatatgccatcaaaagaagaagtcaaacatgctatttttgatattcatccaggaagcacaggaggtcccgatggtttcaatggtaggtttttcccacaaacccgggatatcatagaggaagatgtttacaatatggtattggaagttatgaatggaagggaacttagcaaatttatcactcatacatgccttgttttgattcctaaagtagaaaatcctcaatctttctctgaactcagacccatcagccttggcaatgtaacccaaaagattatcaccaagttgctgaataacagattgtctaggctattgcctaagattattactcctaatcaaagtggattcatcaagggtagagcaatcggagagaatgttcttctgacacaagagattattagtggtattaatcaaaagaatacagggattcgcagaataatggatacacactgtgtggaaccttatatccaatgtatggtactctatccttattaatggtaaaagggaaggtttcttcaaatcagccaggggtttgaagcaaggagactctttatccccttctctatttattatagcagctgaggctctttctagagcattaaacaatctacatgaaaatcctgatttttcaggatttaccatgaataagaagggacctcaaataaatcatctcgcttatgcagatgatttgattattttcacctcaagtaacacaaaatctcttagactcatcaagcagatactagcagggtatgagaaagcttcaggctaacaggtgaataaccaaaagagttgctacctggtaaactatacttgtcatcaaaatagcatcagaattattgaaaggcatctaaagttcagaagggaattttttccttttgaatatttaggatgtccaatatatataggtagaaagaaggtgcaatacttctctggaatgacatcaaagattattcctagaattactagctggcagggtcaacttttatctccaggaggcaaagctattcttaccaagcatgtactctctatcattcctatgcacttgttatccatttgtcgtcctcctaaaactgtgcttaagatgttggagagattcttcgctaatttcttgtggggtcaagcggatgaaagcaagaaatatcattgggcctcttggagaaagttatgctacctactaaagaaggaagaggggttttagaaatttgaatgacaccaccaaggccttcacagccaaaatctggtggcttttaagaactaataaatctttatgggcttcattcttattgactaagtattgcagtagaattcatcctgtgcctaggaaaggaaactcaaagcaatctggctcatggagaagcttaatggagataaaaaaaagaagtagaatcgcatataacatggaggatccaaggaggaaattcttctttctactgggacaactggacaggtttggtgtcacgacccaaaatccactaagggtcgtggtggcgtcggacactgctctcaggcaagccaactaaattacttaataaaaatctcgtttttaatatttttaaaatctagaattttaactccatatttagaaaattttaaagaataaagtttcaaatcgagctttagaattaaacaattaatacaacacttaaatcatcccagaacccggagtcacaagtgcacgagcatctactgataagagaaataaaaatacaacatttgaccggaacacagtggacgaaagtaaatacagtacactggaagggactaccctagttgcggccgtctcgaatgatgcagctcatctagtcccaaatcatcctcgctaatatgtctagaagaccactggagtcacatatacctgtgcaacaaaatgcacagcacgtgtagcatgagtacaaaaataacgtgtacccagtgagttttccgcctaattccgaaggggtagagacgagatggtcaactttgacactcactagtagtccaatgactatttatcattttataagtatattaaacagtggatttaattttataaacatgtttctaatccaaatagaggaaacaagtaaacatataattctttcatggaaaatttccttagattttttgttatttttaacaatatgatctcgagccatagtgaggcataaaacaactcaaatgagtccaggcagcattacaagcatgcacaaatcataccgaggcgacggcccgatccaacagaaattaatgtgcacttgccgagggtcgacggcgcgcctatagatgcatctattaatctgccgaggcgtacggcccgttccaaaataaacatacgcagacagacaatcagtcaaacagtcaacatggagcaaatatccaagaaaggtcaattctctttaataattttgagaaaacagagtttaagtctttttagaaatccatttattaatttaatgtgataaaagcatttcaagccctcaatgggttcacaaataatccaagtataagatacttttgggttctagactacccggacaatagcataatagtagctacgcacggactctcgtcacctcgtgcgtacgtagcccccacacttaggagcacataaacaatttagctcacctatggggtaaattctccctcacaagattagaaaggagactcacctcgctccgaagatccatgaccggcattctacattcttccgaagactcgaaccaacgcacaatgctccaaaactagccaacgattatacaaatccattaatatatgctcgattatattttacaacccaatttataaaaatttctaactccgaacgaaaagttgaccaaaatgccctcgggcccacgtgcccgaaatccgaaatttttcgaagataaagtttacccatgaccttaggaactcaaatatataatttactcctagtcccatgctcaaattcgtggtcaaattcgaagagatgcaaattcctaggttttccaccaaaaccctaaatttctataatttccttgcctgaatccatgaattaaccttgtatttaactcaaagctagcatagattacttacctcatgacaagtgacgaaaatggcacctccaagctgctccccatcgactcccatggaagaaaaatggggttgaaattaactcaaccccgactttaaaagaaccctctgccttcagcgttttctgcttttgcggtccagggaccgctcctgcggtcccgcttatgcggacacacaggccgcttctgcggttccaaacgaggcccctctcttccgcttctccgactcgccaactgcaggtgcggttccgcttatgcggctgctcgaccgcatctgcggtcctcttcactgttggtcaaaaccgcttctgcggtccacattttcgcctctgcggggccgcttctgcggtcccccttctgtagaagcggaaataccagataccagctgcccagtttctccaaaaatccaactttcgatccgttaatcacccgaaattcacccgaggcccccgggaccccaaccaaacataccaaccagtcctaaaacacattacggacttgctcgaggcctcaaatgacatcaaacaatcctaatatcatgaattacacctcaattcaagccttatgaactttgaactttccaacttccacttctgatgccgaaacctatcaaatcacgtccgattgacttcaaattttgcacacaagtcatatttgacattacggacctactccaactcccggaatcggattccgaccccgatatcaaaatgtccacttccggtcaaacttctcaaaaccttcaaatttctatctttagccaaacgactctaaaatgacccacggacctccgacttcacttccgatcgcgctcccaactccagaatcaccatacggagctactcccagtctcaaaattccaaacggacatcgataacgctgaattaaacttcaagccaaacttaagaaatttcttcccaaaatgctaacttccacaataggtgccaaaacgctcccgggttatccgaaacccgaaccgggcatacgcccaagtccgaaatcatcatacgaacctgttggaaccttcggatcccaattccgaggtcagttactcaaaattccaatcctagttcatttcttcaactttaagcttccaaaaatgagaatttccctttaaatttaactctgatcttcctgaatctcaattccgaccatatgcacaagtcaatatatctgaaatgaagctgctcatggcctcagaccgctgaatgacgcgccggagctaaaaacgatcggtcgggtcgttacaatctcccccacttaaacatacgttcgttctcgaacgtgctgagaactacactgaagtagtctgatatcacttgtttaacacctcatgcaccttccccttctaccacaactcagtttagcacattagatcaataattctgtagatacactccttattcaagcaaataagccttaaagcctaatcccaacatccggaatttcctgctaagcttgtttcccacatacgatcactatatcgatcactacacgctgtatccaaacatgaatgcgtaacttgctgaattcgcactttgcattactttactcatagaaccacaataacattccctgatcgaataaatcgaaattccacgaatctgatgctcccattgcacctcatgacctacataggtcttgctctaatctttacggtaccgccacgacggaaaagatgtgccgaaattcataatcaactgctgaatcaacaaatcatcgggtatatactcccaacaagaaccatcacttcattctgagtcgaataatgatctttgctcttaatatacttcatataaccagattgcactgatcctaagtccaaaaatctcgtctcacccagtacaaactgctcaggcaataagctatcccggacatgatcaaaagtcccatatgatgccacaatgtgccaataggctaccactcagaatgcgatacaaaaaggaagcctaactctgaaagggcgatctaattgccccgctcgcgaatcatctatgcgacgcgggcttacagctagcactagaattctgagaaacatataagacagaacacataaaaacaaatatggggaattgtactaaacatcacactgttgcggcgcgtaacccgatccgaataacatagcactcaataaaggagatgcacaatgagctagattgctcattgcaacaaaataccgaatatcggtcagaaacacgctaaggcgtataataccatccctggggacacatatagcgctataggctacaaactcaagcacaactgaagtgcgatacatgatctaaatttcaagagccatcctgctcatataacatcaccgctgagcggaacctcaacccataaggaatttaccaagccgtatcacaactcatacggcgcaatatatctttatatgaaatagctgaccacgaaataacaccgcgactactcttccataaagagcgcattgctgaaatgaacacaactagcctgacgtaaggctcacattcacatttaaatccacccaccgacttcaagtcgatcctgatcgtgcccaactaggccaataacttctcaaaggtccatgctaaattctcttttctcataacacacaagaatatccatcacaactggagcgaacctccacagtctataacccaacaagccgagtgccccttcaggcataaattctcaaattgatgacattaccaaaattcctcatacttggtttaaatctctaatcaatcaagtgactacacgtccctcttataaaatcttcctgtggggcacgctcccccaacctcccgaaataattaacgggtctgcacattcaagccaccggttgcactaacgctgaaaagcgatcaagaatccctaactaggatgcaaagcctttttcacacaacaccgatctcaggtgattctgaagatgataccaatttactcaaaacactgtaactcctttcctgctcatccgagctcgtgacatcacagtcatttaccaaactgcaaccttggtccttacttcaaattccataccactcactgcacccaacgtgccgacatacgatagacacgatttccatcaccactctggaaccactgatagactaacacttcatcatataaaacttttaattttaactcacttcaggagaactatagcaacatacaggagaattcacataaccgtcgaatatgccaatctataagtagtggtccaagccaccataacccttccgcgatccgcctactcataacaggccataaaagaagaatgcttctgaataacatcaatcactgcggccgacaagcctcacacgcaccgccgcaattcacatgcataacctgatcacgctggatgaactgatcaccgctaccaatatgccaagttaactatggcttaatcaatctacttccttccaatttatctttgattgccttagaaataatacctttccatccaacacataacatgctccatctgcactcgtcccgagtgaccaaaacccacgagaccatgctcaattgatgcctggagccaaagaaaatcatcacacccatggtgaaacaaataacgcagaccacgcaaccctgatagaacataacttgtacggaaccaatggtagaaacctctgcactgacatccatcacgaaggcccaattaagaaaagcaatccttttacgaatccgaagtctctactcattttcctcccaaatgctacactgcacgccaacacatcatagaacattctgggcctctactcataagatgctacaaaagcttgattctcaattgcacctataagctcaaaatcattaggcaccacactttacctcttgaattcactaggatcgttatcgagagccacccgctctgacttggtcccgaatgcaaccaactccaccaaattttataacatatgaataccctctcgatgaagcacccagcgggatcacttccctcgaagcctgcacctatacgaggcatagatcatgaatcttccctcaagtctgtacatgagccaataaggccaaccataacatgcatttaacaattcatctgctcgaattacctcttatggtcctttctcatagctgaaataacccaccaacatgctaataaccagaaagcacgcaggtaattaaccatgcaacccaatcatgagcggtgggactctcccacgtggctcaaagccactattacacaactcttgaatttaccagaattctttatctctcattgacataaccttgcacaatcaaccgccaaaattctcaaaatcattcggtaaaaaccctctttttgaactctgaatcatcaaccacatacgcacggtcgatcactttgctgaataaccaatagaattccttgtagaagctttgccaaccacgcgaccgctaacctgctcacagggaataacccacctgtagaagccactttcgacatcctttaacgctcctgcacggggtacgtcactatgacatcaataacccctcataagtccaagcttactctctggctgcaccagtccgtttaccccttgtggacattaactaaatgtgcggcaatatcctcccaagccagagttatgctgcatcctccttcacgtcaagcagctcctttccgctatatcaaatcttctgtcgcataatggcccatgcttcaagttcactccgtaggccccaatcactaatctctgaaattctccaatcattccaaactctccttaaggcgcgtagtcatcctactaccaagcccatatgctacacccgccactcccccactttggcggaactcatccctttaatcgaccattcgaccttgctcctcatacttggccttctagaagttttaaacactgcctgacacttcccaaaggtccttcctcatactttgctgttgttgccttaaataaaatctatcttcatagcactggaacccacaagccgctactaactttaaacctgtccgaaggccttcttcctcgagccatcacattaggaacaccggttccatcctgaaccaccgcatcccgcgatctctaactgttgcttcttcattattgactcgcaataaccttccccaaaggcgaattgaagaaaataataacactggcaatcttaacacattcaatcgaggacgacgataccacgtcgccgatggagactctatcatacttgaaaataccaagtcttatcatctcatcatcccaacctgaacatcctcagcctgattacctttccccctgccgggaataaatgctgaatctttagatcacgaaccgagtaaacctcccttcaagtctttcactgcctccacacataggcaaacatcctgccatcatatcaataccgcgaaagaaaaaaaaaatcattcataagcatcatggcaacctgtgcctatcctcaaggctccgagaaataccgttacccagccaaaacaacaagatatccttccctagggcgactataatagtccattcagccataccgggagaaacatcccgcaccatatctgaaatgccacttaccattcttcaattcttgatttacaacaagcgcttcgcatcgcataagattgagtaggaaggaaacaaaggcataagccttagaggaatcaaatcgcacgataaggaaatcaagaagggaagtactcctaacagccttgtagcctcccgaggataagtacagacgtctccgtaccgatccgcgagactctactagacttgctcatgactcgtgagaccgacgggaacctagagctctgataccatgttgtcacgacccaaaatccactaagggtcgtggtggcgccggacactactgtcaggcaagccaaccaaattacttaataaaaatcttgtttttaacatttttaaaatctagaattttaactccatatttagaaaattttaaagaataaagtttcaaatcgagcttaagaattaaacaattaatacaacacttcaaaccatcccagaacccggagtcacaagtgcatgagcatctactgatcagagaaataaaaatacaacattcgtccggaacacagtggacgaaagtaaatacagtacactggaagggactaccctagctgcggccgtctcgaataatgcagctcatctagtcccaaaatcatcctcgctggtatgtctagaagaccactggagtcacatatacctgtgcaacaaaatgcacagcaagtgtagtatgagtacaaaaacaacgtatacccagtgagtttcccgcctaatcccgaaggggtagagacgagatggtcaacttaatttgacactcactagtagtccaatgactatttatcattttataagtatattaagcagtggatttaattttataaacatatttctaatccaaatagaggaaacaagtaaacatataattctttcatggaaaatttccttagatttcttgttattattaacaatatgatctagagccatagtgaggcataaaacaactcaaatgagtccaggcagcaatacaagcatgcataaatcataccgaggcgacggcccgatccaacaagaaataaatgtgcacttaccgagggtcgacggcgcgcctatagatgcatctattaatctgccgaggcgtacggcccgttccaaaataaacatacgcagacagacaatcagtcaaacagtcaacatggagcaaatatccaagaaaggtcaattctctttaataattttgagaaaacaaagtttaagtctttttagaaatccatttattaatttaatgtgataaaagaaccctcaatgggttcacaaataatccaagtataacatgcttttgggtcctagactacccggacaatagcataatagtagctacgcacggactctcgtcacctcgtgcgtacgtagcccccacacttaggagcacataaacaatttagctcacctatggggtaaattccccctcacaagattagaaaggagactcacctcgctccgaagatccataaccggcattctacattcttccgaagactcgaaccaacgcacaatgctccaaaactagccaacaattatacaaatccattaatatatgctcgattatattttacaatccaatttataacaatttctaactccgaatgaaaagttaaccaaaatgccctcgggcccacgtgcccgaaatccggaatttttcgaagataaagtttacccatgaccttaggaactctaatatataatttactcctagtcccatgctcaaattcgtggtcaaattcgaagagatgcaaattcctaggttttccaccaaaaccccaaatttctataatttccttgcctgaatccatgaataaaccttgtatttaactcaaagctagcatagattacttacctcatgacacgtgacgaaaatggcacctccaagctgctccccatcgactcccatggaagaaaaatggggttgaaattaactcaaccccgactttaaaagaaccctctgccttcagcgttttctgcttttgcggtccagggaccgctcctgcggtcccgcttatgcggacacacaggccgcttctgcggttccaaacgaggcccctctcttccgcttctgcgactcgccaaccgcaggtgcggttccgcttatgcggctgctcgaccgcatctgcggtcctcttcactgttggtcaaaatcgcttctgcggtctacatttttgcctctgcggggccgcttctgcgttcccccttccgcagaagcggaaataccagataccagctgcccagtttctacaaaaatccaactttcgatccgttaatcacccgaaattcacccgaggcccccgggaccccaaccaaacataccaaccagtcccaaaacacattacggacttgctcgaggcctcaaatcatatcaaacaacgctaatatcatgaattacacttcaattcaagccttatgaactttgaactttccaacttccacttccgatgccgaaacctatcaaatcacgtccgattgactttaaattttgcacacaagtcatatttgacattacggacctactccaactcccggaatcggattccgaccccgatatcaaaatgtccacttccgatcaaacttctcaaaaccttcaaatttctatctttagtcaaacggctccaaaatgaccaacggacctccgaattcacttccgatcacgctcccaactccagaattaccatacggagctactcccagtctcagaattccaaacggacatcgataatgctgaattgcacttcaagccaaacttaagaaatttcttcccaaaatgctaacttccacaataggcgccaaaatgctcccgggttatccaaaacccaaaccgggcatacgcccaagttcaaaatcatcatacgtacctgctggaaccttcggatcccaattccgaggtcatttactcaaaattccaatcctagttcatttctttaactttaagcttccaaaaatgagaatttccctttaaatttaactctgatcttcctgaatctcaattccgaccatacgcacaagtcaatatatctgaaatgaagctgctcatggcctcagaccgctgaatgacgcgtcggagctcaaaacgaccggccgggtcgttacatttcggccctttatctaacttttgcaactgctccatttataacaaggataaggtatgtaactttattgttaataattcctggaatattcctaaattgtctcaagctgtcccaggctactttgtagaacacattagaggtaccaaaataggtaactcaaatgtacaagaccaagcaatatggactgactcaactaatggtcagttcagttgttcctcagcctggaatagcttgagacaaagacaaggaatttcttttctgaataagttcttatggcataacgctattcctttcaaaatctcttttttcggttggaaattttgagagacaaactaccgacagatgataatatcaagaaaataggaattccttttccatcaaaatgtgcctgttgtacggatgggcatcatatttttattgatagcaacatcagcaaagcagtctggaaatgcttcagagatcaatttgggattagggactatgatggtgatattaggcaacatatgatagtttggtggctctctgaataccagaaccccatccataaactccttcttcaagcaacccctttagtcatcagttggaacatttggaaagcgagaaataagagtaaatatgatcaacaaaggttctttgttcctaaaattatacaccaaatttgccatgatgttacactgattatccataagcagttaaagcaggttgacttagcaattccatgtgcgcaattgactcagatgattgtggaagttagaccacagttgaatattatcaaagtctcatggaaatttcctcaagaagggaccattaaattaaacactgatggatgttctagaggtaatcctggtattagtggtggagaaagggtcattagaaggcacactggagaaatggtgggtgcatttgcagcatcttttggtacctagaataataatgtagctgaatctttggctctaaatatgggggttgcaatggtgcatagatcagggacacaaaaatattattgtggaattagattcactcttagttattaactggatgcttggaaagtttaatcctccttggagtttgctgactactattgaagaagctaagaggaagactaatttctttaatgaaatacaatttatgcattgcttcagggaagcaaacaaagtggcggatgtgttagctaatgaaggagctgagataaatggtgttaaatggttttactctactcatgaacttccatctcaggccgggggacacttatacatggacaaggatccactccctaattttagaataagatactccaaaaagctattttgtttatgatccacttgataacaatgttgctactttttgtgctttggtcagtcactgccagttgtgaataagggaaatggtcctttccaaacgataggatcttcattgtatatccttcttcatgagtccaggaatatgccttcattttcttttgttttagtgaaggttaggttttatgtccccctccttaatgtgtttacctctgaattttaatttacaaggtaggggtccatgccaaaccctctgtcacctaaagacggattatttttaaaaaaaagaagagatttttcatcacgaattcgaatttagctaggcctcatacgaatactaaacaccgattgggaaaagaaacacatgaatcgtagccttccaaaatagaaaaggcaagaaaatagggaaaatgatattgtatagctgctctcaaaataatagccaaaaagtgtatatatattttttgtgtatattcaaaaattatacaaattttatatactttttcgccaaccaaatataaataatgtctggcgcgggctaaaagtaataatacccgaaaaaataacgagacccccgacatattcttaaggaataattgtaaaatgttgcgcatgctcaacgggcgtatttattttgttcggtagtttcttcgaaattttttcgcgaactgagcactaattttcgacttggaatagtgtctgtaattctgactataactttttctagttatacaaataaagttcatctatacattcaatcagttaaactttgcaatttctgtaatgtctatttgaaaatcatgaaaaaattatttacacactttgattcgagaaacttgagagagttcataaactagtgtgtaccatttaatctgacataaacttctcagtttattgttaatgatatgctcataatcacaagttctaatgagatgtacaaaaagttttttttttccttatatgcatgatgcatggcaagtacataatgcgaaatgcgacataacaatcgcaaaatattatatatcaatttgtcaaattcggtttaatgcgtttatcaaatgcgatttataagttgcatttagtaaatgcgacttatatatcgtatttctccatggcgacttacaccatcttgaccagcccatacattctatttataagattgaattggtgcgcataaattgctcccggaaatattctgatagtttttccctaaatagttttgacgaattgggccagatatggggagggggttgaaacaggttaggcaaaacactagctatagggcgcatgcaatcaaacactatcctaaaaaatgaaatgcaacatagtaataaagaaataattataaaacgaaagaaataatataaatttcacttaaacatagagatgacaattacgttgcaaacgaaaacaagacataattaagttctctgataataaaaacaagcatgacatgaccatccatatccataagaactgaatggagatttctgatacatttgttcttacttccaacataaaactaaatattaaactatacttgaacacacacaaatcagcatacgtcttcatattcctaggtaattagttgtgaggcttagcttcagttactttatccaagttttcacttcctcctccaaatccagctccattttcattaccagtgttataaccgaaaaaatcaggtgtcatgcggaaactaacaaaacaaaccttgaacaacgataaatgagacaacaaaggagaaatctaccaaaagagacacaaatatttaatgtggttcggtcaactaacctacgtccacaatggagatgagcaatccactatataaaagagagtacaaaatatcgagagaacaacctcacgaagaggcaaacacaagtgacacactaacacttgtcccgtaaagttctccccctaaacacgactctcaaaccccatatggctacattgtggatgctgctgaatgagaagggcggatcctcaatttatagaactccaaaccttttcctacaagaaaagagactagccaaatacggaagaattatatttttcttctaggaaaagaaaaacctaattatggtaaatatgttgtcctttccttcatgaaataggaaaaccaattatggtaaaaaaatctggacaaacacctaacaattctcccccttggcctgaattttctgacaaaatacttgatctgccttcttcacatagccttcaacaggtcgcatctctgaatctccgccacaaagtttgtttcaacgtgcgtagcactccagtcaaatttctcatacaaaaatcatgattatcgtcaaataagttacggctagaactaaatccgccaagatgatcctgtcttgaacctcgctctgataccactagttatgaccgaaaaaatcaggtgtcatgcggaaactagcaaagcaaaccttgaacaacgataaatcagacaacaatggagaaatctaccaaaagagatacaaacatttaacgtggttcggtcaactgacctacatccacaacggagatgagcaatccactgtataaaagagagtacaaaatatcgagagaacaacctcacgaagaggctaacacaagtgacacactaacacttgtcccgtaaagttctccccctaaacacgactctcaaaccccatatggctacattgtggatgctgctgaatgagaagggcggatcctcaatttatagaacttcaaatatgttcctacaagaaaagggactagccaaatatggaagaattatattttccttctaggaaaagaaaaacccaattatggtaaatatgttgtcctttccttcatgaaatagaaaaatcaactatgataagaaaatctgaacaaacacctaacaatcaggatatgctccgccacaatatccaccatatcctcctccacgaaatcctcctcctcggaatcctccaaatcctcctcctcggaatcctccaaatcctcctcctccagatcctgaaactcctgctcctagaagtttaatttggtgtcattttcctcatttttattatcggataacttttttgcaagaatgtgataatcatgcatatgcatgttagattgataattagctacgcattatcaaaaacattattagctacggaagattagcaatagattagggacgaatttggtagctaattcctattttttttggtagtagactttttagataaatctagttgttaagagcagaagttaattaatgcaaaataaatcaagtccataatgaccataaacataagaaaataatccatctttttgtatggcgttgttaataagttgaattttatgagttcaagttcgggacgttgctaccggactcatttaatttattgggtttaaaatcaattatttgcacttgttttataaatcatttaacacatgtataaggttctagtgaagctacttggttttgataatcccatataacttacactacgtagcccctttgtttgactgacaatgaagttcaagaaggaaaaaaaagatttataaaaaataatcaactctaaaaaatactataagagacttttttcctaattatcaaagtgatcgtcaaattaattatttttatatattgaatgtttattatgagaataacctatagctcattccaaaacaaatactcttatgtttcaatttatttgaacatattttctttttagtctgccaaaaaaaataattaatttccatatttgatatcctttactaatacttttatactatgtaccaatatattttaaagtaggggactttcagggcctaaaacaattgctttagaggctttttccatagcccacctaagcacaaattactgcataaattgaacagttggtttattataaaattcaagttattcattccaacatatagatatataaattttagtatcctttattaatgtaatgacccgattgttcgttttgagcatttgcacttcgctcggtagtttacgagcatgagtagctctgtataatgtattatgactagtgtgaatcgtcagtttttatttttaggttatcggaattgatttggaagaatgattctcaactagcaagctttaaattaggagagttgaccaagtttgacttttaagtttttgacctgggattggggttttgatggctccgttagctccgttggatattttggacttaggagcgtgtccggattgtaatttgaaggtccgtagttgaatttggcttgaattggcgaaagttggatttttgaaaagtttgactgggagatgacttttttattttggattcggattgtggttttgggaattggaatagcttcgttatgtcatttgggacttgtgtgaaaattttggatttatccggggttggtgtgataggtttcggcgtcaattgttgccttgttggtatgtttggttgagttctcgggggcctcgggataattccggatgattttcggaacaagggttgaagttgaaaagtagctgaaggctgctggttctagtgtttctgcatctgcgtcgttcgcagatgcggacacctggtcgcagaagtgaaggaagccttggctggggatcaccgcagaagcggaattttcgtaacgcaactgtgtgcgcgcagatgcgagatttgagcgcagaagcgggctttggtgcagatgcgggtccttttgtcgcacctgcgatgttgcaggagcggatgattttccgtaggtgcgaggtccatttctccagtgcttcaccaaggaagcggagtgtttgtcgcagaagcgacgtcgcagaagtggccctttgttcgcaaaagcgaaaatcgctagccagaagctatataaaaatcgagggttttggttctttcttcatattttgagatgtgggactcggattaaggcgacttttgaggcaattttcatcacaagaattggggtaagtattctacactcagttttgattatatttcttgaatctatatttattttgggcaattggttgatgaattttaaagagaaattgggggttttagcctaaagtttcataacgtgaattttatagttttgaacatcgatttggagtcggattttagagaaactagtatggttggactcgtaattgaatggattattggattttgtgagtttcatcgggtttcgaggtacgagtccaagttggacttttgggcgattttgggctttagattaagaattcgacctttatcgattgggtttgtatcctttggcattatttgatgtatttgagttgcttttggctagttttgagcagttcggaggtcagtacacatgggatggcactcttggagcattgcttggcttgcttggtattggaatttgcttgttcgaggtaagtaacacttctaaacttggtgctgagggtatgaaaccccgaattacgtgttatgtatttggtgtcgaggtgacgcatatgctaggtgacgggcgtgtgggtgtgcaccatgtgagtcgtgactctcttatttttgtggtactttgtagttatctgatcttagctgtaaccataaaaactctacgtactaaagtaattgagctgtcaatcatgctagagatcatgtttaagctatatgctggtactgttgagactcatagtggtcgtttcttgcgattgatttattgatttcattggaatttcgcattcagtcatattcattcattacatatcattcctcagtctctgttgttatttattgatatatcatatcataattttcgggctagtttcatgacattgtgagcccgtgagagagagattggagagattgatgattgagtgctaccgagagcctgattatgaggatattgatattattgcatgtgagttgtccgtgcagcacgtgcgttgttcgtgcaacacgtaagttttccgtgcgggtcctgatattgatactatagcacgtgagttgtccgtgtggattatagcgcttgggataaaggagcccctccggaatctacatacacccctagtgagcgtggttgatttatactgagggatggatcttccatggacatggattttgtctgaagcatttatagctggggatggatcttccccacgcgctggattggccctacttagtactaagtgactgatggtcagttgatgtatatattctgggatggatctttcctgggccggattggccatatccagtactgagtgattgagcatgatgagtgaaaagtgtgagacagtaagattaggtactttgagagtgtgagtatatgagttcatatctgagatacattgcattgatatgcacacataacatacaagcatagagatgtatattcctcatgttgtacggtatcacgtcatttatgactcctcacacatgttgacatatgggcatagagatgtattttacacttgctatctggaaagaaaatgaaacatcttatttattattgaaaggatttttgggaaattaaagaattgcagttttcaaacttactcatatttttggcaactccggtaaacgacttgggttttcactgatatacttgaaaggcagaactatttttcaggaatcatgattaagctgagcaccttatctctgagttacttcttctgttacttttatgttgttatggactgttgctggctattggtgttggacctgacctttgttcccagctcgtcactactttcaacctaaggttagacttgttacttattgagtacatgggatcggttgttgtcacgacccggattttttaccctcgggagtcgtgatggcgcctactattaggagctaggcaagccaattaatcatcaaatacttcttttagcaacctcaacaatattaaaacaacgagatatttaatataaaagcggaagtctgaaaatataaataaccgaaagcaagtgcggaaattcaaaatacatcctctacctaagactggagtcactaaactcacgaactcctacaaaatgctaaatacagagtctgaaataaaaatacaatactgtttgttccgatacaaaggaaatcaaatggaaatagagataggagagactccgggccatgcggacgtcagcaaagctaccttggggtctctggactgaagtcagctcccgaatatcctactgctgtccaaaagctgctcctggatctgtgcaaaaagatgcacagagtgtagcatcagcacaaccgaccccatgtgctggtaagtgcctgacctaaccccggcgaaatagtgacgaggctagacaggacctaccaaaataaacctgtgcagacatatatatacaagtacaacgaaataaccgcgtaaaataataattaagactgggaggggaacatgcttttgggggtagcagataaaacaaaatagcagggataaataaggaaaactacaactaattccttctaacacagaataagtggtcggcgtgccacacaatcccgtttcataatatatatataagtggtcggcgtgccacacgatcccatttcataatatgtataagtggtcggcgtgccacacgatcccatttcataatatataagtggacggcatgccacacgatcccatttcataatatgtataagtggtcggcgtgccacacgatttcatttcataatatatataaaggtttcccggcaagggaacaagtatcaattcaactatctcggcaagggagaatacaagtaaacagctaattcccagcaagggagcaacaacaatatcttacacgtcccggcaagggagatattcaatatactaaaacagcccggcaaaggaataattacctctcttcctcttttgttcatttctcactccctaatcatgtcattattcgagccaacgctccaaggagtttacaaatcataattctttttcatactcttcacattacatagaaaccatcaaataaacaaggaagagtcgcaacagaatcccaaataagcacaaataaggactcacggtcatgctagacaccagtgtatagatactcgtcaccatgcctatacaccgtactcgacatttagcaattagcaaacaatactctaatcctaatccctcaagccaaagttagatcaaacacttacctcaaactttcacggctaagtcaatccttaattaccgctttccctctcgaatccggctccaacacaatcaaatctatgaaataatgactttataatatcaataatagctaaacaaactaaacccaaagcctaaatattgatttctatcctttcctcccaaaattccaaaaatcgaccccggacccgcttggtcaaaacacgaggttcgaaccaattccatatcacccattcccccatgagcccggatatacaatttattttcaaattcgaccccaaaacgaagtctaaatcaaagaaaatcgaaaagccctaactctacccttttcccccaatttcaacagtagattacatgatttaggcttagaactcactaattaatgaaggaaaagtaaaggaaatgagtgggaatttacttacccaagtggtcttgaagagtgggggcttcaatggagtcctagagcttgggggagaagagagctcgtgagaaaaatggataaatcccgtatgttctgattctgtaattttaaaaatataactgggcgtttttgttctatgcgatcgcggaagaagggatgcgatcgcatagggaagaggaaattgaccattgcgatcgcatactaagtattgcgaacgcattgaagaaatggtgttgaaatttccaggtttggtttaatgttgtgcaatcgcgagagaatgggtgcgttcgcactgaagaagctggccaagctctgcaatcgcgagggagtctatgcgatctcattgaacaaatgcggacacctggaagctcacactatgcgatcgcagaaaggcctatgcgatcgcatagaaggaacaactggacagctgactgcagaaattctgctgcatttcctaaggccaaaacaccctgaaccacctccgaatcactcccgagcgctcggggctcctaaccaaacacacacactaactcaacaacatcctacgaacttaaccgtgcgatcaaatcgccaaaataacatcataaacgaggaatcaaacctgaaaatcaacacttttcattcaaacttctaaaacttccaattttaggtatttaggtccgaaatacgtcaaatgacgtccgatttcgaccaaattacacagaaacatcttaaaccatatataagacctgtaccgggtgccggaaccaaaatatgggcccgataccaatattttctaatccattttcatttcaaactttcatatttatttcagaaaaacaatttctttcaaaaattcatttctcgggctcgggacctcggatttcgattccgggcatacgcccgagtcctatatttttctacggatccttcgggaccgtcacatcacgggtctggatccgttcacccaaaatgttaaacaaagtaaaccttagccattttaaagccacattttagaatttttcacagaatttaacacataagctttccggctacgcgcccggactgcgcacgcaaattgaggcaactaaaagtgaggttttcgaggcctcggaagcacggaaaaagagagaaaataggtgatgaccctttgggtcgtcacattctccacctctaaaataaccgttcgtcctcgaacagacaaaagaaagaagtacctgagtcgggaaatagatgagggtaacggctccgcatatcagactcagactcccaggtcgatgcctcgggaggctgacctttccactgaacacgcactaaaggaaaactcttcgacctcaattgtcgaacctgccggtctaaaatagccaccggctcctcctcataagacagatccttgtccaattggacagtgctgaaatctaatacgtgcgatggatcgccgtgatacttccggagcatagatacatgaaacactggatgcacgactgataagctaggcggcaaggcaagtttataagccacctctcccacatgatcgagaatctcaaaaggaccgatgaacctagggctaggcttgcccttcttcccaaatctcatcacgcccttcataggcgatacacggagcaatactcgctcaccaaccatgaaagcaatatctcggaccttgcggtctgcataactcttttgcctggactgggttgtacgaagtctatcctgaataatccggaccttatccaaggcctcctgaaccagatccgtacccagtaaccgagcctctcccggatcaaaccatccaactggagaccgacatcgcctatcatacaacgcctcatatggagtcatctaaatgctggactggtagctgttgttgtaggcgaactctgctaaaggcaaaaactggtcccacgagcctccaaaatcaatgacacaggctcggagcatatcctctagaatctgaatggtcctctcggactgaccgtccgtctgggaatgaaatgctgtactaaactcaacctgggtgccaaactctcgctgaaccgctctccaaatatgcgaggtgaactgcgtaccccgatccgaaatgatagatagcggcaccccatgaaggcgaacaatctccctaatgtagatctcagctaatctctcggacaaataggtggctgtaacatgaacaaaatgcgctgacttggtcagcctatcaacaatgacccaaactgcatcaaacttcttccgagtcatcgaaagtccagtaacgaaatccatggtaatcctctcccacttccactcgggaagctcaatcctctgaaataaaccaccaggcctctgatgctcatacttaacctgctgacagttcaaacatcgagccacatatgcaactatatccttcttcattctacgccaccaatagtgctgcctcagatcctgatacatcttcgaggcgcccgggtgaatagaataccgagaactatgggcctccgctaagatcaactcccgaatcccatcaacattgggcacacaaactcacccctgcaatctcaaaacaccatcatcatctaaggtcaccttcttggcacctccacgctacaccgtgtctctcaggacacacaaatggggatcatcaaactgccgctcacggatacgctccaataatgaagaacgagcaaccgtgcaagctaacactctgctaggctcataaatatccaacctcacaagacgattggccaaggactgaacatccaaataaaacaatctctagctgactggaatataagcaagactgcccatggtggcggacttcctactcaatgcatcggccaccacattggcctttcccaggtgatacaagatagtaacatcataatcattcaacaactctaacaaccttctctgcctcaaattcaactccttatgcctgaacaggtactgaagactcttgtgatcagtgtacacctcacatgtcacaccatatagataatgcctccaaatcttcaaagcatgaacgatggctgccaactcaagatcatgaaccggataattcttctcgtggatcttcaactgcctcgaaacataggcaatgactctgccgtactgcatcaatactgcaccaagcccaatacgggaagcatcacaatagactgtataaggccctgaacctgtaggcaaaaccaataccggtgtcgtagttagagctatcttgagcttctgaaagctcgcctcacactcgtctgaccacctgaactgggcacccttctgggtccacctagtcatcggggttgcaatagacgaaaacccctccacgaaccgacggtagtagcctgctaaccccaagaaactccgaatctccgtagctgaagctggtcgaggccagttcttgactgcctcaatcttctttgggtccacctgaataccctctactgatacaacgtgacccataaatgcaaccgaactcaaccagaactcacacttcgagaacttagcatataacagactatccttcagagtgtgaagaaccaccctgaggtgctgctcgtgctcctcctggctgcaggagtatatcagaatatcatcaataaagactatcacaaacaagtccaaataaggcctgaacactctgttcatcaactccataaacgctgttggggcattggtcaacccaaatgacatgaccaaaaactcatagtgcctataccgagtgcagaatgctgtcttagggacatcagacgccctaatcctcagctgatggtagctagatctcaaatctatctttgaaaacacctttgcaccctgaagctggtcgaataaatcatcgatcctcgatagtggatacttgttcttaatcgtcactttgttcaattgccggtaatcaatgcacatcctcatcgaaccatcgtttttcttcacaaatagcaccggcgcaccccaaggcgaaacgttgggtctaatgaaacccttctcaagcaaatcctatagctgatcctttaactctttcaactctggtggggccatgcgatacggcggaatggaaatgggctgagtgcccggagccagatcaatacaaaagtcgatatccctgtcgggcggcatacccggtaggtctgaaggaaaaacctcagggaactcccgaacaatagaaacaaaatcaatagaagggacctctgcgctggaattacgaacatacgccagataatctagacaccccttctcgaccatgcgtcgagccttcacatatgatataacactgcgagtggtatgtcctagggtccctctccactctagtcggggcaaatctggtaaagccaaggtcacagtcttggcatggcaatccaagatggcatgatacggggacaaccaatccatccctaatataacatcgaaatccaccatatctaagagcaacaaatcaacacggtctcaaaacccctaaataccacaacacaggaacgatgaactcggtcgaccactatagaatcacccaccggtgtagatacataaacaggaacactcaaggcatcgctaggcataaccaagtagggtgcaaaataggacgacacatatgaatacctagacccagggtcaaatagcactgaagcatctctatcacagaccagaatagtacctgtaatgatagcatctgatgactcagcctctggtctggctggcaaagcataacaccggggctgggccccacctccctgaatcacatcccttggacgatcggctgctggctcacctctacctctggcggtctgagctccacctctatgacctctaccttcacctctatgtcctctacccccgcctctagctggctgggcaggctgtggagcaaccggtgcctgaatcataggacgaggtccctgctgctgagaactacctgaagctcgagggcaatacctagcaatgtgactcatgtcgccacacgtataacaagccctcggctgttgggaataacgaagtgggggtgcactgataggtgctaatggcgaactgtaaagctgctggtctgaataaggcggctgagaaccacgaccacctgatgtaccatgagagaccagtagagctgactgaaagggcctcggagggtggcctctaccataagaatctctacctccagacgaggtaccactgaatctccctgcatgacggggcatcttatcagacccatgaccacctccctgtgcaagagccatctctatcatgcgagccgcattggccgcctcctgaaaagaaatatcacccccggctcccatagccatctggagacggatcggctaaatcaaaccatcaataaacctcagcaccctctctctatcggtggggagtatcacaatagcatggcgagatagatcaatgaaccgggtctcatactgtgtgactatcatagagccctgctggaggcgctcgaactgcctacgaagagcatctcgctgagtaactgggagaaacttctccaaaaataactctgcaaactggtcccaagtcaatgatggcgaccctgctggcctggctaaacaatagtctctccaccaagtcttggcggatcctactagacgaaaggtggcgaagtcgacccattggtctccacaatacccatagtccgaagaacctcatggtagctgaataagaaatcccgggcatcatctgaagaagtgccgctgtatgtggtagtgaagagcttggtgaatcgatccagtctccatagagcatcggtggacatcgccgcaccatcgccggtctgagccgcaatacccggctgaactgccacagctggctgaaccactggaacctgagcctgacgagctacctgctccggagtacgtgtagcgggagtctaaactcctcccccagcctgagaagtggatggtgctactggaagcaaaccctctctagtgacgctctccacaaagcctaccaatctgaccaaagcgttctgaagaactggagtggctatgaacccatctgggacctgagctgggcccaccggagctgctggagctggaatctcctcgtcataatcagtatgaggctccacctctgggactgctgctcggggctgagctctgcccctgcctcggcctctggcacggcctcagcctcgccctctacccctaataggagctgctactgggggctcgggctgctgcgcggtagaagaggaagcacgtgttctcgccatctgcgaaagaacagagtagaaagacaatcagtatttgagaaacagaatcgcacgacaagaaataataaagtgaaattttcctacctctatagcctctgggggataaatacagacgtctccgtaccgatccttcagactctaccgagtttgtccgtgagttgtgagacctaagtaacctagtgctctgataccaacttgtcacgacccggattttccaccctcgggagtcgtgatggcgcctactattaggagctaggcaagccaattaatcatcaaatacttcttttagcaacctcaacaatattaaaacaacgagatatttaatataaaagggaagtctgaaaatataaataaccgaaaccaagtgcggaaattcaaaatacatcctctaaccaagactggagtcactaactcacgaactcctacagaatgctaaatacagagtctgaaattaaaatacaatactgtttgttccgatacaaaggaaatcaaacgaaaatagataggagagactccgggccatgaggacgtcagcaaagctacctcggggtctctggactgaagtcagctcccgaatatcctactgttgtccaaaagctgctcctggatctgtgcaaaaagatgcacagagtgtagcatcagcacaaccgaccccatgtgctggtaagtgtctgacctaaccccggcgaagtagtgacaaggctagacaggacctaccaaaataaacctgcgcagacatatatatacaagtacaacgaaataaccgcggaaaataataattaagactgggagaggaacatgcttttgggggtagcagataaatcagaatagcagggataaataaggaaaactacaactaattccttctaatatagaataagtggtcggcgtgccacacgatcccgtttcataatatatataagtggtcggcgtgctacacgatcccatttcataatatgtataagtggtcggcgtaccacacgatcccatttcataatatataagtggatgacgtgccacacgatcccatttcataatatgtataagtggtcggcgtgccacacgatcccatttcataatatatataaaggtttcccggcaagggaacaagtatcaattcaactatgccggcaagggagaatacaagtaaacagctaattcccggcaagggagcaacaacaatatcttacacgtcccggcaagggagatattcaatatactaaaacagcccggcaagggaataattacctctcttcctcttttgttcatttctcactccctaatcatgtcattattcgagccaacgctccaaggagtttacaaatcgtaattctttttcatactcttcacattacatagaaaccatcaaataaacaaggaagagtcgcaacagaatcccaaataaacacaaataaggactcacggtcatgctagacaccggtgtatagatactcgtcaccatgcctatacactgtactcgacatttagcaattagcaaacaaaactctaatcttaatccctcaagccaaagttagatcaaacacttacctcaaacttccacggctaagtcaatcctcaattaccgctttccctctcgaatccggctccaacacaatcaaatctatgaaataatgactttataatatcaataatagctaaacaaactaaacccaaagcctaaatattgatttctgtcctttcctcccaaaattccaaaaatcgaccccgggcccgcttggtcaaaacacgaggttcaaaccaattccatatcacccattcccccacgagcccggatatacaatttgttttcaaattcgaccccaaaacgaggtctaaatcaaagaaaatcgaaaagccctaactctacccttttccctcaatttcaaccctagattacatgatttaggcttagaactcactaattaatgaaggaaaagtgaaggaaattagtgggaatttacttacccaagtggtcttgaagagtgggggcttcaatggagtcctagagcttgggggagaagagagctcgtgagaaaaatggataaatcccgtatgttctgattctgtaattttaaaaatataactgggcatttttgttctatgcgatcgcggaagaagggatgccatcgcatagggaagaggaaattgaccattgcgatcgcatactaagtattgcgaacgcattgaagaaatggggttgaaatttccaggtttggtttgtgcgatcgcgagagaatgggtgcgttcgcactgaagaagctggccaagctatgcgatcgcgagggaatctatgcgatcgcattgaacaaatgcggacacctggaagctcacactatgcgatcgcagaaaggcctatgcaatcgtatagaaggaacaactggacagctgactgcagaaatactgctgcatttcctaatgccaaaacaccccgaaccacctctgaatcactcccgagccctcggggctcctaaccaaacgcacacactaactcaacaatatcctacgaacttaaccgtgcgatcaaatcgccaaaataacatcataaacgaggaatcaaacctcaaaatcaacacttttcattcaaacttcttaaacttccaattttagatatttaggtccgaaacacgtcaaatgacgtccgatttctaccaaattacacagacccatcttcaaccatatataagacctgtaccgggcgccgaaaccaaaatacgggcccgataccaatattttctaatccattttcatttcaaattttcatattcatttcagaaaaacaatttctttcaaaaattcatttctcgggctcgggacctcggatttagattccgggcatacgtctgagtccaatatttttctacggaccctccgggaccgtcacatcacgggtccgggtccgtttacccaaaatattgaccaaagtcaaccttacccattttaaagcaacattttaaaaattttcacaaaatttaacacataagctttccggctacgcgcccggactgcacacgcaaaccgaggcaactaaaagtgaggtttttgaggcctcggaagcacggaaaaagagaaaaaacaggtgatgaccctttgggtcgtcacagttgtactcatactacacttctgtaccttgcgtacagatgttggctgttgatgttgctgtgatcgacgggagccagaattgaagacgtacctacgttccggttgtatttgcctcttgttcatggtagccttagcttcataaagctctgtttatgtacttttcgaacagatgatgtatttatttcataccaactttgtaaattctattcatagaagctcttgatttgtactactatttcttggggaatgtataagattcaggagttttcttttaattaattgtcttattaaattttattggaattagatagttattaatcggcttacctagtgggttgagtttggtgtcatcacgactaattgaattttgggtcgtcacaattaataattttattatatataataatattttttttaaagtgtcagccttcaattgttgaggcccaaagcaattgctttagtggcttttccctgagccgccctaagcacaagttacattgaacagttggtttaaatgaaacattaaactcttgaaatgtatgaaacaatattagttgcgggctataattggtggagctcttagtcagcaccctatttaagttataatgtcacgacccaaaatccactaagggtcgtgggccggacaccgctatcaggcaagccaaccaaaaatacttaattaaattcaaattttagtgcttgttgaaatcattttccttatacatttaaataataaataataaaatttacagaaatgattatagagtctttaacaatttagtgtagaataatccaaaacttatcccagaacccggtgtcacaagtgcatgagctatttctaggaagcaatacaatacaacaaccgtccggaatacaatggacagaaagtaaatacaatacgctgaaggagactatactagctgcgggccgcctcgagaaatgcagctcgcctagtcccttcatcatccatgctgctacgcccagtaggccattcgaagaacatgtgcctgtgcaacaaaaatgagcaagtgtagcatgagtacgaaaacaacgtgtactcagcaagtatcccgtctaatctcgaagaagtagagacgagaggtcgacttcgacacttgctaatggtccaataataatataataaaaatatgaggaaatcatggatttatatagcagttataactcacaaagtcgaaaaataggtaaacacctttaacaaataataaaggatttccaagacttacttttcattatctttatcaatttatatcgggccatgaaaggcaatatcaacatttaaaactctcaggcaagcaatataagcatgcgcaaatcatgccgaggtcgtacggcccgctccaacgaaaatgtaaaatgtgcactaccaagggtcgaacggctcgaaccatagatgcatctattaccccgctcgcaaactatcctgcgacgcggtcaacataaaataaacaaataccctgctcgcgaatcatacatgcgacgcaggtacacatagaaatacatgctcatacagccaattacggaattatcgaggaacatttatccaaataaaagccaatcctctttgaacaatttaagaaaatggagtttaatccttttagaaattcatttactaattcaatgtgatttaagaaattcaagttgtcaataagtttacgattaatccaagtataacatgcttttgggtcctagaatacccggacaatagcataatagtagctacgcacgggactctcgtcacctcgtgcgtacatagaccccacaaataggagcacataaccaattaactcacctatggggacaattctctattacaaggttaaaaaagacactcacctcgctccgaagttccaaaaccggcattctacgccctttcgaagactcaaatcgatgcacaatgcttcaaaactagccaacaattatgtaaacccattaaaatatgctcaaacacttataacaattcaatttatatcaattcccaactccgctcgaaaagtcgataaaaatcaccctcgggcccacgtgcccggattctgaaaattattgaaaataaatattacccataactcatatgttctatatccagaaattcatccaactttgtctatgaatcgaccctcaaatcaaggatttatcatttttcaactttgatgctcaaaatcccaatttctaccattcagatacggataaaaatagaaaccaatagaaataatcacggagaaacatcaaaataaaggtcagatatttacccccttgtttatacgagaacaatgacgcaaaaatcacctcaaacggagctgtagaactcaagatatgcccataatactaaaattctcggtttaaagcactgtccaggcgatttttcttcatcgccttcgcgggagacgttcgcgttcgcgaagggaaatttttcgcattgactggtcaacccataaatccttcttcgcattcgcggaacctcttcgcgttcgcgaagaacaaatcttcgcaccagaaactagcaagttttcccgacacggaaatgagcataactccctcatacgatgtccaaattcgacgattctttttgctatggctccgtaattatgatacggatctaatggttcaatagaaatttaattttgagcttattttcataatattgttccctttatgtccaaagaaatgacgttgaaacatcaaataagagcgcgatacaacccgaaacacacccgagacccccgggaccccgtccaatcacaccaacccactccataacataacacggacctgctcgaggcctcaaatcataccaaataacatcaaaactactaattgtgcattgattcaagcctaataaactattgaacttctaacttttacatccgatgccgaaacctatcaaatcacgtccgattgacctcaaattttgcacacaagtcacatttgatattgcggacctactccaacttccggaatttaaatccgaccccgatatcaaaaagtcaaactctcggtcaaacttctcaagaacctttaaatttctatctttagccaaaagacttcaaaatgacctacggacctccgaattcacttccgatcgcgctccaaactccagaatcaccatacggagctactcccagactcggaatcccaaacggacatcgacaacactgaaatgcacttcaacccaaacttataaaatttcttccaaaatgctaacttccacaataggcaccaaaacgctccctggtcatccaaaccccgatcctggcatacgcccaagtccaaaatcatcatacaaacctgctggaaccatcagatccctattccgccgttgtttactctgaaatccaatcttagtcaattctttcaacttaaagcttccgaaatgagaattccctttccaaatcaacttcaaattccccggaatttaaatccgaccatgcgtacaagtcataatacctgaagtgaagctgctcatgaccccaaactactgaacgacatgctagagctcaaaacgaccggtcgggtcgttagattctctcccacttaaacatacgttcgtcctcgaacgtgctaagaactgtgttggggttgtccgaaatcactgtttaacacctcgagcacctacccgtgctaccacaactcagctgggcaccctagctcgatcaatctgaagatatcctttttcacttaagcaaataagccttagagcccaattcctacatccggaattctttgccaagactgttccaacatacgctcaccgtgtcaatcaccacacgatgcaccagaacatgactgtacacctttgctgaattcacaccttgcaccgctttatttacaggaccacaataacattctctaagcataatagtcgaaatttcacaaatctgatgctctcattgcacctcatgacacacacagttcttgctctaactcttacaataccgccacgacggacgagatgtgcagaaattcataaccaactgctgagtcaaccaatcattgagtctatacttctgacaagaaccattacctcattctgaaccaaataatgatctttgctccttaatatatttcatgaaatcagattgcacttatcctaaatccaatgatctcgtctcacccagtacgaactgctccggcaataagccaccccgacatgaccaaaagtcccatatgatgctacaatgtgccaataggctaccaattacaatgcgatacaaaaaggaagacgaactctgaaaaggagatccaattaccccgctcgcgaatcatacatgcgacgcgagcaacatactaaacagacaccccgctcgcgaattatacatgcgacacgggctcacagctaatacgagctttcctcagaaaataggaaatgaaacacataaaaaccgatataaggaactgtactcaacatcacactgttgcggcgtgcaacccgatccaaataacatacccatggcggcgtgccacccgatccacacatagaattcacataaggagatatacatcgagctaaattgctcattacaataagataccgaatatcggtcacaatcacgctaagtgcatactaccatccttggggagacatatagcgccataagctacaaaactcaagcacaactgaggtgcggtatacgacctgaatctcaagagccatcatgctcatataacatcatcactacgtggagcctcaacacataagaaatttaccaagccgtctcaccactcacacggtgttatatatcattacatgaaatagctaacgacgaaacaacaccccaactactctgccataaagagcgcattgctgaaatgaacacatctggcctgatatagagcccatattcatatttaaatccattcacaaacctcaagccgattctgatcgtaccgaactaggacaaaaacctttcaaatgtccatactaccttccctttttctcataacacacaagaacaaccttcacaatcggagtaatcctccacagtccacaacccaataaaccgagtgcccttcaggcatcaattctcaatttaacaacatcactacaattttcatacttggtttaacttcttcaatcaatcaagtgactacatgccacacttatacaaccttcctgtgggacacgctcccataacctaccataacaaataacaggtatgtacacccaaaccaccggtcgcactaacgctgaaaagcgatcaagaatccttaaccaggatgcaaagcctttttcgcaaaacacctatctcaggtgacgctgaagacaataccaatttactttaaacatccaacctttttcttactcatccgagctcctgacatccttaccaacaccgaactgcaaccttgatcctctcttcaaattccataccactcactgcacccaacgtgccaatatacgatagaacacgattttcatcataaatctggaaccactaatatactaatacttcatcatataaaacttttcattttactcactttaggagaaccatagcaacacacagacgaattctcataaccgtagaatatgcaaatctctaagtagtggtccaagccaccataacccttccgggatccgcctacacataacaggccataacagaagaatgcttttgaataacatcaattacggcgaccgacaagcctcacacgtaccgccacaaatcacacgcacaacttgatcacgctgagtgaactgatcactaccaccaatatgctaagtcaactatggctaaccaatctatcttccttcgatttaccctgattgccttagaaataataataactccattcaacacataacacgctccatccgcactcaccccgagtgaccttgaatcgcgagaccatgctgtctcaaatcccatgaaccatttcatacatcccaaatgctacactacaagtcaaaacatcatagaacattttttgcctcttctcataagctgctacaaagcttgattcttaatcgtacctacaagctcgacattattaggcaccacacttgttacaacccatatccacacacgttagttcattccatatattagttaacatatatccaagaaggaattatcctttagatgataagaagttaatcatattggtcttaagtaatacaagggcgtataagggtgattaacaagtattagacgttaaacgaattaagaatgttctaactcataatttcaggtaaacctagaggtgcttaatacactcaagaggtcatgtattaaggtatttgaatcatataatatccgtatcataagccctgaagtcaaacgagttatgaaacaaaagtcgacaaaagttgtcgcaacttaggttcatagttttgcttaaactttaggtcaaatgttgttacgcttttctcccaatttacttggagttaaagggtgatatacccaccaaattgaagatctatgagtctagtttctcacgcattaaaccgttcgtcgatacgatctcgtagtagagagatattcgcgttttcgcgagactgcgccaagcacctctccatggggcccactaaggcggtttgagacatttggacctatataggatgcctccaacccgtttttagacatttcttttcactattttcagaacttagaaccctaggaactccctctcaagtttctctcaatattcaagacccaaacaaagggcaaacaacacaaatcaagtgtcgggaatcccgtggcgctagtaagtctcttattcttcttgttgttgctcatttttgtgatgttacagctcgtgtgggaggttgttttaaagggtttaggttctgtaaatactccctcatgttcttaatatcaatcctaggtgatttcaagccttctaaagtgattctagtgccggaaaacactaattgatcgctagtttcgctttcttgttgttgtggcagcattgaagggatatttcatggaaacttaaggtcaaattggagttgttctttctgtataaaggtaaggaacctcttaccctatatgtatataagattatccaagttgcggctaagccattgaagctagaacttgtgaaatatatatcgaaaggtttggtagtaatgttatcggttggtggactattttgggaggctcaatttgattattattgatgttatttgggctgtttggtgatggtttggaattgtgtgaagtcatatatataggggaggtgctgtccgttttatcgtaaaatagattggggtcgatacataatagttatgacgctcaaatgataacgatagtatcgtttctcttattgtggactaaggagttgtgacaattgcatagcttgagattggggtagtatatataaggtatgtgaggctattcccttccttcttttgcacgactcttattgtacacaatgcaaagaacgagctttaaaagatactctactcttagaagctagcagtacttacgttgtttgccctcttatggaacgattgatgttaatgttgcttctcttatccttatgttattatgttgttggtacttcttgattcttataaggttcatagtgaagagttagtcctaataacgtgtacaaaggataccgaccttacgtcactcctaaaggtttagaacgtgattccatgagtcgagcatgcattatatatatgtatctattttactctaccgagccgcgctatagacggccgggtatggcacctattgtgcaaccactgatcagttgggtttaccgagctccacgtggccgggtacgattctaccgagccttatgatggccgggtacgtttttaccgagcctattacggccgggtacgatatgatgatgatgatgcccacagaggcgaatgttttaaaagtttatatatttatgcacatgtatcaagcatttcatgtcagtagccctcagaggtactcagatgttacaagttgtatattctctatccctgcttacattactgatcgtatttatggttccctgccttacatactcagtactttattcgtactgacgtccttttatttgtggacgctgcatgtcgtgttgcaggtcctgatagacaggcaggtgcagctcccccaccacagtaggctgtccagttcagcggtgatgggcgagatcccttctccggacttgccttggccttggtatgcatttttattatagacattatgggtatgtcggggccctgttccggctatgttgcagtacttatgttcctttagaggctcatagacaggtgtcgactcatgtatagtttggtatgccttgtcggctagtttttgttgtatagtctttcatggtagcgtggtagctctcaccttatatatagtttcctgattgtctggtcatcccatattatgtatgttcatgccatcagattttattgttggttgtccatgatccatgtctactatttatattgatctcgtcagccgtaaaggataataaagaaggttagataaaatgtacgttagtgctcggcaagtatggtcgggtgctagtcatggccctccagtttgggtcgtgacaacactttaccccttgaatccactaggaccgcagctgagagccacgcgctctgacttggccccgaatataatcaactctatgaatcttattgcacatgaataccctctcgatgaagcacccggcggaatcacttcccttgaaacctgcatctatacaaggcataaatcctgaatcttccccaagtctgaacatgagccgataaggccaaccatagcacacctttaacaattcctttgctcaaattaccacttatgttcttttcccgtagctaaaataacccataaatatgctaataaccggaaacctcacaagtagttaaccatgcaacccaatcgtaggcagtgggactctcccacttagcttgaagccactatcacacaactctgggattcaccaggatcctttatctcttattgacataaccttgcgcaatcaaccgcttgaattctagaaatcttactgtaaaaccccttttcatactctgaatcatcaaccacattcgcacgaacgatctctttgctgtataaccaataaaattcttcgcagaagcttcgccaaccacgcgaccgccgatcttctcactggagacaacccatctgtggaatttaagtgccgatatcttccaatgttgctgcacggggtgcaatcactacgacaataataacccatccggagtccgagctcactctctagctgcacaagtccattcacccctcgtggacatcaattaaggccccgtttggccaagagttttggcaaaataaatttgaaatttattttcaaaactcatgtttggccataaattttgcctatattttggccaaatttcaaatcccaaatcccaaatctcaaaatcagctcaatagctgattttgggccaaagtcccaaaacttgggaattatatacatgtttttattatatacatgtccaaacacattttcatcttcaaatcaaacttcacccaaatcagatttttcaaaataaatttgggatctatggccaaacgctagctaaatgtgcagcgacatccttccaattcaaagttatgctgcatccttcttcattttatcggctcctttcccttatatcaatctcctgccgcataataacccctacttcaaattagatccgtagaccccaatcaccaatcactaaaattcccaaatcgatccaaactctccttaaggtgcgtagtcatcctactaccaagcccatgtgcaactccgccagtctcccacttagggcaaactcgcttctttaatcaaatactcgacctgcgcttcttatacctggccttccagaaattttaaacaccgcctgacacttcccacatgccctttctcatactttgctgctcaatcgttgccttaaataaaatctatcttcgtaacacttgaacccacaatcgctagtaaccttaaacctttctaaagatcatctttctcgagtcgtcaacattagaaacaccggttcgatttgaaccactgcaccccgcgatctctaaccgtcgcttcttcaatactgactcgcataaacctgccccaaaggcgaattgcagaaaacataacaccggcgaacttaactcatagaatcgaggacgacgataccacgtcgccgatgaaaactccaccacacttgaaaataccaagtctcgttcccccatcaacccaaacctaaacattctcagcctgattgcctttcccctaccgggaataaaataccgaattgctagatcatgcactgagtaaacctcccttcaagtaattcactgccccgacacgtaggtaaacatcctaccatcatatcaatactgcggaataatcgttcataagcatcatggcaacttgtgcctagcctcagagctctcagaagtaccgctactgagctgaaacaacagaatatccttccacaaggcgacgataataactcaaacaaccccgtagggagaaacaccccgcaccacattcatagtgccattacaattcatcaattctcgatttataaccagcagttcacgtcgcgtaagattgagtatgaaggaaacaagggcctaagcctcaaggaatcaaatcgcacgatgaggaatcaagaagggaagtactcctaacagccctgtagcctcccgaggataagtacagacgtctccgtaccgatccgctagactctactagacttgctcatgacttgtgagacctaagagaacctagtgctctgataccatattgtcacgacccaaaatccactaagggtcatgggccggacaccgctatcaggcaagccaaccaaaaatacttaattaaatttcaattttagtgcttgttgaaatcattttccttatacatttaaataataaataataaaatttacagaaatgactatagagtctttaacaacttagtgtagaataatccaaaacttatcccagaacccggtgtcacaagtgcatgagctatttctaggaagcaatacaatacaataaccgtccggaatgcaatggacaaaaagtaaatacaatacgctgaaggagactatactagctacgggccgcctcgtgaaatgcagctcgcctagtccctgcatcatccatgctgctacgcccagtaggccattcgaagaacatgtgcctgtgcaacaaaaatgcacagcaagtgtagcatgagtacgaaaacaatgtgtactcagcaagtatcccgtctaatctcaaagaagtagagacgagaggtcgacttcgacacttgctaacggtccaataataatataataaaaatgtgaggaaatcatggatttatatagcagttataactcacaaagccggaaaacaggtaaacacctttaacaaataataaaggatttacaagatttacttttcattatctttatcaatttatatcggtccatgaaaggcaatatcaacatttaaaactctcaggcaagcaatatatgcatgcgcaaatcatgccgaggtcgtacagcccgctccaacggaaatgtaaaatgtgcactgccgagggtcgaacggctcgaaccatagatgcatctattaccccgcttgtgaactatcatgcaacgcggtcaacataaaataaacaaataccctgctcgcgaatcatacatgcgacgcaggtatacatagaaatacatgctcatacagccaattacggaattatcgaggaacatttatccaaataaaagccaatcctctttgaacaatttaagaaaatggagtttaatacttttagaaattcatttactaattcaatgtgatttaagcaattcaagttgtcaataagtttacgattaatccaagtataacatgcttttgggtcctagactacccggacaatagcataatagcagctacgcacggactctcgtcacctcgtgtgtacgcagcccccacaaataggagcacataaccaattaactcacctatggggacaattccctcttacaaagttagaaaggagactcacctcgctccgaagttccaaaaccggcattctacgcccttccgaagactcaaatcgatgcacaatgctccaaaactagccaacaattatgcaaacccactaatatatgctcaaacactcataacaattcaatgtatatcaattcccaactccgttcgaaaagtcgataaaaatcaccctcgggcccacgtgcctggattctgaaaattattgaaaataaatattacccataaatcatatgttctatatccataaattcatccaacttcgtctatgaatcgactctcaaatcaaggatttaccatttttcaactttggggctcaaaatcccaatttctaccatccaaacacggataaaaatagaaaccaacagaaataatcatggataaatatcaaaataaagtccagatatttacccccttgttgagatgagaacaacgccgcgaaaatcacctcaaacggagctctagaactcaagatatgcccaaaatactaaaattctcgatttaaaacactatctaggcgatttttcttcatcgccttcgcgggagacgttcgggttcgcgaagggaaatttttcgcgttgaccagtcaacccataaatccttcttcgcgttcacggatcctctttcgcattcgcgaagaacaaatcttcgcaccagaaaccagcaatttttcccgacacgaaaataagcataactccctcatacgatgtccaaattcgacgattctttttgctatggctccgtaattacgatacggatctaatggttcactaaaaacttaatttggagatcatttgcttaatatggtaccctttatgtccaaagaaacgacgttgaaacatcaaataagagcgcgatacaacccgaaacacacttgaggccctcgggaccccgtccaatcataccaacccactccataacataacacggacctgcttgaggcctcaaatcataccaaataacatcaaaactactaattgggcattgattcaagcctaataaactattgaacttctaacttttacatccgatgccgaaacctatcaaatcacgtccgattgacctcaaattttgcacacaagtcatatttgaaattgcggacctactccaatttccggaatttgaatccgaccccgatgtcaaaaagtcaaactctcggtcaaacttctcaaaaaccttcaaatttctatctttagctaaaagacttcaaaatgacctacagacctccgaattcacttccgatcgcgctcccaactccagaatcaccatacggagctactcctagactcggaatcccaaacggacatcaataacactgaaatgcacttcaacccaaacttatgaaatttcttccaaaatgctaacttccacaataggcgccaaaatgctccctagtcatccaaaccccgatccgggcatacgcccaagtccgaaatcatcatacgaacctgctggaaccttcagatccctattccgaggttgtttactctgaatccaatcttagtcaattctttcaacttaaagcttccgaaatgagaattccctttcaaaatcaactccgaattccccggaattcaattccgaccatgcgtataagtcataatacctgaagtgaagctgctcatgaccccaaactgctgaatgacgcgctagagctcaaaacgaccggtcgggtcgttgcatataactagtcaattactacttgagttgagaatgaatacattttctctatttatagtgtcattatctgaactttctttggggcgaatattgaaaaatatattaatggaataccagacaagttattaagttggcggctatgccatttgtctcaatttatatgatagagttggaatttcgagagttaaaattttgatcgccaattcaaatataaatttattatgttttgaaataaaatttatatattcggaagctatataaaaagtatactataagtcaaaataattaacaattgaaaatatcaaaaaattatatgaaaaaatagtacaaattaattagcatatcataaatattgccaatattagccaactagctatttgtaaccaaaaaaaaaaatcaaatttgtggtctgattagttcctgaaattttttgtcttgtatttcatgtcacaaattcttatactattggaaatgtaacaagttattttaaaaattatgataagtttaaaacggagcaaattttacatggttacaacataacgttgcttgcatgttacccaattgagaatttgtgtctctatattctgtgattagtaaagaggatgtttttggattatagatatgccaatcctctttttgttattgtttaaacattatcgccattgtaaaattttggcatgtctcaatttcaactaaatggaggttcttttatgtaagacatcttaccttaagaataattagatgttcttgttgtcagcaagcatagattagtaacaccgatatataagcattaagtgaactcattaagtagccttgttatcatatctcatactaatgccaatctttgacggttacaggaaattatgttagtcaagtcttaagatcttgttgaatttcttaccaacatctggttttcatggtatgtgctacctttttcttctgcatttgattgttttgataaattataattggatcacaattagaattttctaatttctttctcttttgatcctttgctactattttttttaacataggaaggataaaattctccaacaactggaaatatagtcaaccacagacttgggaggagtttgaaggcaaaggaatagtttggagacattttatgttattttttggatcgtgtatatatatacaaagaaaatgtatattagaatactttatgctgtttgactttttagcaacgaaaagtgatattatatttttatttttctgccttattgactgcaaattatctttgtattttatgataattgtaattgtcattaatcatgataatttatagtgacagttttattttgtcattaaaagcgatgtttttagtgatgaaatgattgtcttagctacaaaattgtaagccaattttattaaagcaaatttgtcaatattttttatatttagggacgaaatatctttttgtatataatagcttgtctttagtgacgaaattatatttattgaatcacgaaatacatataactttagagacaattaatgttgtcactaattaaactaaatagttagtgacaaagaagtttcgtcgctattaatggtctctttagtgacggaaacgtattatcaactacaattttttttatattcttttgacaaataagttcgtcataaatactacacatttggggacaaaattaaatttcgtagctaatataactttatttagtgacgaatcactaagttgtctttgtatacctttagtgacacacatttaatgacgaatgattgacgaattgtttttcgtcaaaaaaagtttttagcgacgaaatatgaatttcagatgataaaataatttgtcaccgataatcgaatctgttgtagtgattggatacatcttaagagtttaaatattagttttgggatgatttggtagagttttgaggtggttttaattgaaaattcgaagtagaagatgaacatggaaaaaaataatatgtgtaacacagtgtgtatcatttgtgtgtcatatatgtatcatatttatcaaatatatattacatgtatatctatgtatatttatttgtgtgtgagatatatgtgtgatacatatttgatacatctgtcgtagacactactagaaaactggtaaaatccgtccacagaataacgatcgaaatcggtcggaaaaaagcgaccgaaatcgatcgatatatttatttttgttgtcagtcaaagcgttgaattaaccgaccgacttcggtcggaaaattgcgaccgcctgatcgcaatcccttggtgaccattattttttcgactaaattaaaagtggtcaaaaatcggtcgcttttcctcaaattccgactgatgtcggtcggttttggtggacgaaatttggaagttttctagtagtgagaagaattttttgaactcgattttaactaagaattttgataccaaatcagtccaaatcacatccaatcttcctcaaattttgtatgttgactcatctatatgttttctatgaatttcaaccatacccattgaaaaaggttcctttttgcttatatttttggaatcttgtatacatttatttttgttggtatttcatcacgtcgtttgctagctcatccataaacttttcttttggtcttgttgtttaaccaaaaaataggattctagtcaaatttaagaatttagaagaatacgggttactgataatcgaaagaatgtaagtaaaaagagatttagctggaaatagtataatcagaagaaaagcaagtagaccaaaatatattcagatggtatttcgtgtccttacaattgtctattcctctcccttttatagttattttggggatatgttccttaccttagtcataacaaggctattatgggcaattaatgacattaaatcctacgttactcaatcattacattaaatacatattctctaacgtttttagtttttaatacccattaaatactgtatttggactctcatgtgctgtcagattcattcccttgattcttcttgattctcgaacttaaaatgtcttgaataggtatgggcgctgaattacttgaataactgcccgtgcctcttccgttacctttgctcgtatccgttgctgctcgtgcctcttggctaattataattctttgaccatttgactagtctacgtgtcatgacacgtcatctccaatatgtaaactcaatttttcccaatacgatatgacgacccgatcggtcgttttgagaaattaagctccgttcagcggtataaggtctggaacagcttcggaatatgagtatcgacttgcgtgcatggtggaattcggctttcggatggtttagagtcaaattggaagaaggaaccttgttttggaagtttgaacggtgaaaagttgaccggaattggacatttggataaacgaccccggaatgggtcgtggatgatattaacagcttcgtatggtaattttggacataggcgcaagtccgaattcagatttggaggtccgtagagtgaattgaggcattttggcaaaaattggaaaggttgaagtttgggaaatgaagaagtttgacccacagttgacttttgtgatatcggggtcggaatgcgattccgagagttgaatcagctccgttatgtcattttggacttgtctgcaaaatttggcgttattccgagttgaattgataggtttcggtatgagattcgataattggagatttggaagttcataagcttgatttttggtttgattcgtcgtttcgatttcgttttatgtgatttgaaacttcgagtgagtccgtgttaggttatatgacttgtgtgtgtgattagacggggtcccgggagcctcgggtgagtttcggataggtttaggctatgttgcgcttgtttttggatgctttgtcgttgtttcttcaagaaaaaatgataccatattgagtaaatgagatccaaattcagttttgtttgaaccattagatccgtatcgaaattacggagtcataggaaaaagaatcatcgaatttggacatcgtatgaggaagttatgctctttttcgtgtcgggaaagttgctggtttttggtgtgttcgcaaatgcgaactttttcatcgcatttgcgatgcccagttcgcaaatgcgaactttttgtcgcaaatgcgacttcagccagccctgttttgttcgcaatttccaagggttcgcaattgcgaactctgggtcgcaaatgcgacatctaaggcctgttaagtgaggtttttgacgggattttcacccatttttcaattttctcaaaccctaaacctgcataggcaattttctaaagacccaaacttctccaaatcattgggtaagtgtctctaatccatttccaactatattttgtgattatatcttagatttaacatcaaattcatgagaatctaaaggaaaatttggggaaaattgtgaaacctttcaaaaatgtaaaatgatgatttgaatgaccaaatggtatcggaattagataatacttgtatgggtgaactcgtagcggaatgggtgttcggtttttataaattttatcgggttccgaggtgcgggcccgtggagttgacttttgttgactttttgcaaattgtataagaatcatagttttatcaattaaaattgttttctcttgcattgtttgatgtattcaagttgtttttggctagattgagctgagcattgatgaattggtaaaggaaaagctaaattgagtattgaattggccggattgaggtaagtatcttgcctaaccttgtgtggggacttccccttaggatttgagtcttctttgttgattgtattccgtgtacgcgaggtgacgagtgcgtcctcggatttatttgtggtaaattatcccttttaggctcttagacccttgtaatcactgagtatgaagtttttcttgatacgattgagttccctattattagttttacctctacatatcttacttggaatttatttgccctttttggtttattcttgctgcctaattgacctttacttgtttaactagagacatttacccttatatagccatgttagctttcctaactacttgtctttaattggaaatcattatttttatctctcatgtaattaatgggccttaattgaaaagaagttcgatatcctatgcttagttgatatttccgtacttgaaatttatttgatttgtgttaacttccttgtggttgaattacgtattatggaatcgttcttcgtagtattttcttccttgttgagttattcttattgcgcttagtatttctctgttatggttattccttgtgagttagttataccgtctactggtgaccggaagtacctgagtcgattcccttgccttgttctgtatatatatttgcatttgttgtgttgtacttgagatggtggtgcacgaggtttctgccgtgcggttgttgatattgtggtgcacgaggtttctgccatgcggttgctgatattgtgatgcacaaggtctctaccgtgcggatgttgttgaggagttgcacgaggtctttgccgtgctgttgttgctattgatgttttgcatatgcggcgtaataaggcgggatatgtttacatgctcatatgtgggtggcgcatgtggcggaataaggtgggaatattgtgatgcacgtgtggcgaaataaggcggtgcttactatattattattggttgcacatgtggcgaaataaggtgggttatgtcagaggctgattgtaatgaattatgatggcctgtggaggcattcctattttgtttactatggtgattgtgggttgcttacctatatgagttttatcgctcgaaagtcgtgaggaaacattgtacgtgtggtccgttctcctattcatgtttactagttggtagaattcttgttagaacacttgcacaagcatacacgtagtttaatactcccgttagaggcgaattgctcataattttgctaaggatggaggtacgccctcgttaatccattttatatatgagagtggccatagttagccagttagtggtcagcatgaccgagggactgatggggcacaggatgccaagtgttagattgcagatgctgggttttcgtgagttgtggttgttcgagatttcttgtaaaaattgtggaaagagccgaataaggccttatctgaacatcactgtaggatacgagttattgacttgtttttcccttgttgtgttgtgacctcaggatttggattgtgatttctgccgtcattttcatatcatcatttattgtattctcgttgttacttattgcccgtttaccttattgtaatttgtagcatttttagtcatctgtgcagtctttacatatttacatatcatttccattatttctatgattatactgtttattgaccggtaggtgtcttgactgttcctcgtcactactccaccgaggttagtcttgatacttactgggcaccgccgtggtgtgctcatgcaactcttctgcacatttttgttgtgcagatacaggtacccccattcagttctgtcagccttggaaggaggcgtatcggtagagacttcgaggtatatctgctacgtccgcagaccgaagagtccctttccggctttctgtaataagtatagcactttcagtatttctcctttgtatagatattcttgagtcagagcctcttatgtatcccttagcttgtgatttgtgagattccgggttttgggaatttttgttagtttcaagagttgttattgtatgtgccaggcggcactctaaacactgatttattttgctagttcagtttttaattattttcttccacaatttggtttatattccgcattgttaggcttatctagtcgtagggactaggtgccatcacgacatgttcacggagggcgaactggggtcgtgacatacagatagtccccccacttttcatttattcatcagttgaatatttgggaagtggatttcattaaaagaaaatttttgtcaccattaatgctatgacaaaattgacgcttcaattgtctcttccatttaatgcttcgtacacgtgttattttctcattggctctgcaattttgcagcccttttcaaggcttttttacggctccactgttcacgaagtgttagttacctttattatggtccttccatcattacactttttcctttgacggttgtttatcagtataaatataacttctttccttgtcttttactacataaagctttattgaatacttaattcctcaaatcactgttcacttcttcctcacatcattcttcttcgctatgtcttcaccaaaccctaaccctaaccctaggagagttcctattttagatacctttcccaatgcccccattagacatagaaggggaggtaggcttcgtaacttagggtccactcgtggtggtggttcatctatgccctttcctagttctggtccttcttctagaaccagaggttccttttctcaaaaatcttcttctaggggtaaagaactgtaacgacccgacccgtcgtttctcgtatttcagccctgttatccccgttatatgattcctcgtgggtaattatatgtgtttggtaagtttgaagtggtttgagttgaaattggatagaaatgggacaaatagtctctttaagaaaggcttaagttggaaaagtcaacccaacgttgacttatgggttagagggctcggaatggatttacgatcgcttgattagtttcggttgatgatttatgacttaggagtgagaacggaagtgaattcggaggtccggtgtgaaagttagttgagtttggcgaagttagtatttcggagaaatccggttgataggtgagattttgatccgagggtcggaatggaattcctaaagttgcattagcttcgttatgtcattatggacttgtgtacaaaatttgaagtcaatcggatgtgatttgataagtttcggcatcgggaatagaagttggaaacttcaaagttcattaagtttgagttggaggatgattattgattttagcaatgattgatatgatttgaggtctcgactaggtccgtgatgtgttttaagacttgttggtacctttggttgaggtcccggggggtcctgggggtgtatcgggtgagtacggacaccccggaacttagaaaatggaagttgcagtcagtggcaggcggaccgcagtcattttcacgcggccgcaatgcctggacgcggaccgcggccatttccacgcgggccgcatgagctggggatcggcaggtcactggtccgactttggaagctcataacttttgatctataaggaattttgagatgattcaaacacgaaagttgtagcccttcgtgtctagtttccagaaagataaagaaatcgtaatttggacatctgtagagaaagttatggccaaaatggtgaagggtgtcactgcagtccacttctgtgcggccgcatgtcatttttgggcggaccgcacaggttgatgcggccgcatggtgtttttgtgcggtcagcactgtagcaatccgaggggtacttgtataaatacgaggttttgagttttatttgatattttacccgtgggagctcggatcttggcgatttttcgaaggtttttcaagaaattcatcggggtaagtgattctaactcaaatttggttgaagtacatgaatataccattgaattcatcatttaatttgtgaattgaggtggaaaaattggaagaactagggtttggttcttgaaatgaaaatgatgatttaaggggtcaaatggactccgattttgatgaaattggtatgtatagactcggggtgagacgagggttattgtgatgtaaaaatttctggatttcgagacgtgggcccggggctcgggttttgtgattttcgtgttttgagctatttttcgagttctttcaattgggatatgttccattagcatcatgtaatatattcgatgtgattttgggcagattcgtcgctcgtggaggagaattctaaaggaaaaggcatttcgggctagttttccggccggttcgaggtgagtaatgggtgtatgtgattgcctgagggttcgaaaccctggtaaatcaccttgtgatgctatagtgatgatgagacgcgcactccatggctagtgcggggttgtatgagatgaaaattgtgactcggctcaacccgagggataaactatattatattagcatctgttatgcttactatattgatgatatatggcttaatgccaggattggggccatgtgccgacttgaataatcctttagggattgatatgggcttaatgctatgattggggccttgtgccgacctgtagaatccttcagggatatatttatttgcattatcatgttatgtactttatttggacacaatccaaaggttttgaaactctatttttggtaaaaactcagccacaatgatacgttttgaaaacttaaatatcttttatgataatttgggccggtgatcactgattttactatatttctggactgtggatgactcatggaaacggtggtaactattggcaccgtatatacatatattattcttaacggtggtaacaataggcaccgtatattataatggaagcagtggtaactattgacactgcatatcataaatgaaaacggtggtaactatggacaccgaatattatcatggaaacggtggtaactattgacaccgtgtattcgtatgaaaaacggtggtaactattgannnnnnnnnnctgatggctgatgattccccgatcgaggggcgagttatgatttctatgagttgatgttgggccagtctggaggacttgtggccgaatttttgtttatggcttgagcacgaggtgctgattctacgagctggtattatgagctcctatgtccagtattatccttaattgtggtaacggtggctggatagcttcatggtaagtacgtcggtgccgtgtggtgagtctgtatgacttggcaatgtcgaggaaggtctgctagatgttaagcgaatcattaagtgtttgatttctattgtgatcagatgtgttgccccgagttattagtgcgtaaagaatccttttcgagtctcctagatgggagtgaagtgtattgcatgttgtggtcggagtttagactcaggaagaccaattgattgcgtggggtattaatggtaagtggtgtaccgaaattttatgttgaagcaagcaggtgggtatcgtttgcaaattattctgaagaggtatgcttattatgagtaattaaaggtatgtttctagatgttatggttccggcaggtgcaacgcatgttcaggtaccaattttgataaaataacacgtgtagccttgagatttctgttattaatatacattgtggtattttgttcagttgtggtcatgttgttaggatgatttggtggttctctgacaggtggataggcccagttacaagggaaactctgccgaaattttcggaaaaatttgggacttagtgaaaattttgtcgcctaaagaatgggcttaacggtggtgtgaagggatgcaaagttagaatttttgatgatgcgtgttttcgcaaacttatggaagagtgagtttaacctcgctatgatattgcgatggctatcgaatatgtgtgttttaatatatatggcttcgagctaagttggggaggttgttgttgatgagctggtggtgcggttacgtactgtgttggttcaattggatgcaagtgagtgaatcagttctggctgcagaaagtgaaccgaggatggcacaagtgaagcaaaatgttgccaaaggttatatggtacttcgtagatgtgagaaaatagaggaatgtattgagttgtgggtaaaagaatgcttaatgtaaggagaaggaatttgtttggttgtatcgaaatgagatctcgtcatgtggtgtcagaatgctgataaggcacgagaggtttgattcattaagtagagtgttttgtagtgtatataagagtggatgacttttgagaatggtttttgatgtgatcgagattcgatatgtatcactcaggtgttttaaggctgaatgtgtgattaagtcagcggtttcattagaacaggtcgagacttggggtattttatgttgattacgtgaattctatgtagcagtatttggggaagtaagaggaattaactcagagtcgcatgaagttcttcgggcaaagtactttggagatgtatattttctatgggcatgcgtagcatggagtgtaataatttttcttctaaataggatcaaggaaagttctagactagttgggtgcgtcgaggtctgcggtgcagaagggagatgaaagtcctcgtgttatccttggaggatattgtgtatgcggtatgttgtaaaggaccgagatgggcgtgtgcgagttttcgactcaggtttgaaaggtacggtggatttggctaagtcttaggtaatgagtagcttcaggtaatcaaggaattggtactgttaactagaagtgatttggcgatggcatatgtttctgaaagagggtaatctcacaaaggatacatcaatagtgtcacggcggtttcttatgggatcgattgcggatgtctgagtcgttggatggcacatgtgagttataaaaatatatttcgtggaataattgggcattcgaggtgtaatttgtattccacattgtggaaagttgaatccgatgcagtacatgtaggggctatgaattgtgtggagtgttgatattgtcagcaactaccgggagattggaatctggagggatctttccttgcttggtgtattaaattctggatatgttatgggcatgtagagtgattgccccagtgtcggattattcgaaatgattgtgcgatgagtcatgtggggaaatgccacaggttgcgtggcgaggtgtatcgggctatgttctagctggagggttgtattccagagaccagcgatcatctggggagaattgtgttccttaattaggccttcggggcaaatatcggtatagaggttactaccattgatttcagttccggtgttgagggacttctcatatgcgtccttgtggtcgggcatgtcgccgggagggatggtgatttcagtaattgttcggtgtcgggcaccatattgtacggctctggtatgagtcttggtagtggaaatggaattttgtagcttgtaacgctaagtgaatatgtttctgcactcagttggcttacgcccagtgctggtattttgttattatgagcaaattcggctcgatgtgcacctccctatatgaggtggttgtctagatcgggtggcacgccgccacgatgtgatgaactatattcttgtttcctgacttccgagtggagtctgcgactgagtgatgaatattacttgtttcaccgtgagtgtgatgggttactcgattttaggcattgatctgagcacggtaacatgaggtgctttatgcgtaacaatgttgggataggatcgcatgttgtggcgaggccacgtctatttcctatgatatgagacggggtctcagctttgttttgaaagagtattgatgaacttgaggtataactcttccggttgagtcagttgccctgagttgggtatgtctagactgtttcttattggcacgtgaattatgcaagttgtgacttaggtctgtattgaggtatcatatcaccagaagtggtgttagattcgaggtgatcattggggtcattaatgaatatgaacagaatggtttcagctggtgagaaggataatgtcgaggtttggtccgaaaatctgtcgtagtaatggttattatggaagtgacttcataaatggtcagtctgaagaactactacagttcgttgcgtgttttggttatcattggcagcatacgaaagtgctggattaaggctctagctaaataaggggttatcttctggtattgagtattgtgggcaattgctgtgaatagagactatcgttctaagtgttggaatggggagtataatgtgtgaattcacctgaggttgcaaatgtgggctattacaactggttcggattgattctgagtttagaggtgaagttctgatttggtgtatgatttcggaaagtgcaatgtgattttgcggtttatgggctagatggattgtaaaatttcggctgtgttgtgttatcggcacctatgtgagttagggtgatgtgggatcactccgggcatatgtctggtaatgtcatgtgattactgggttgcttctagtacagctctgagtacgctcgaggacgagcatttgtttaagttggggagaatgtaacgacccgacccgtcgtttctcgtatttcagccctgttatccccgttatatgattcctcgtgggtaattatatgtgtttggtaagtttgaagtggtttgagttgaaattggatagaaatgggacaaatagtctctttaagaaaggcttaagttggaaaagtcaacccaacgttgacttatgggttagagggctcggaatggatttacgatcgcttgattagtttcggttgatgatttatgacttaggagtgagaacggaagtgaattcggaggtccggtgtgaaagttagttgagtttggcgaagttagtatttcggagaaatccggttgataggtgagattttgatccgagggtcggaatggaattcctaaagttgcattagcttcgttatgtcattatggacttgtgtacaaaatttgaagtcaatcggatgtgatttgataagtttcggcatcgggaatagaagttggaaacttcaaagttcattaagtttgagttggaggatgattattgattttagcaatgattgatatgatttgaggtctcgactaggtccgtgatgtgttttaagacttgttggtacctttggttgaggtcccggggggtcccgagggtgtatcgggtgagtacggacaccccggaacttagaaaatggaagttgcagtcagtggcaggcggaccgcagtcattttcacgcggccgcaatgcctggacgcggaccgcggccatttccacgcgggccgcatgagctggggatcggcaggtcactggtccgacttcggaagctcataacttttgatctataaggaattttgagatgattcaaaaacgaaagttgtagcccttcgtgtctagtttccagaaagataaagaaatcgtaatttggacatctgtagagaaagttatggccaaaatggtgaagggtgtcactgcagtccacttctgtgcggccgcatgtcatttttgggcggaccgcacaggttgatgcggccgcatggtgtttttgtgcggtcagcactgtagcaatccgaggggtacttgtataaatacgaggttttgagttttatttgatattttacccgtgggagctcggattttggcgatttttcgaaggtttttcaagaaattcatcggggtaagtgattctaactcaaatttggttgaagtacatgaatataccattgaattcatcatttaatttgtgaattgaggtggaaaaattggaagaactagggtttggttcttgaaatgaaaatgatgatttgaggggtcaaatggactccgattttgatgaaattggtatgtatagactcggggtgagacgagggttattgtgatgtaaaaatttctggatttcgagacgtgggcccggggctcgggttttgtgattttcgtgttttgagctatttttcgagttctttcaattgggatttgttccattagcatcatgtaatatattcgatgtgattttgggcagattcgtcgctcgtggaggagaattctaaaggaaaaggcatttcgggctagttttccggccggttcgaggtgagtaatgggtgtatgtgattgcctgagggttcgaaaccccggtaaatcaccttgtgatgctatagtgatgatgagacgcgcactccatggctagtgcggggttgtatgagatgaaaattgtgactcggctcaacccgagggataaactatattatattagcatctgttatgcttactatattgatgatatatggcttaatgccaggattggggccatgtgccgacttgaataatcctttagggattgatatgggcttaatgctatgattggggccttgtgccgacctgtagaatccttcagggatatatttatttgcattatcatgttatgtactttatttggacacaatccaaaggttttgaaactctatttttggtaaaaactcagccacaatgatacgttttgaaaacttaaatatcttttatgataatttgggccggtgatcactgattttactatatttctggactgtggatgactcatggaaacggtggtaactattggcaccgtatatacatatattattcttaacggtggtaacaataggcaccgtatattataatggaagcagtggtaactattgacactgcatatcataaatgaaaacggtggtaactatggacaccgaatattatcatggaaacggtggtaactattgacaccgtgtattcgtatgaaaaacggtggtaactattgataccgtgtatcataaaggaaacagtggtaactattgacactgtaatatatatattgatatagcgctcgggctgtaggagcccttccggagtctgaacccccacagtgagtgcgggtacccatatggatggctcgggctgcataccgcagtggacatgctttgtattgcatcatactcatatgatattatctgttgcttcgtacggataaattgatgatattgggataagtggaacggttaatgtttagccttgttatgtgctttatttggatttcctgctttcgggtatttacatattttcattactcactgagttggtagactcaccccatactccctgtaccttgtgtgcagattcaggtgttgctgaggcatagttttgcggttgccattggttccagattattcagagcattggggtagctgctagcgtccgcaggacccattactccgatccgtattattctcctatcagtatttcagattctgtattactttctgttcggatagtgtacctttcatcttccagatttgtattctgttttgttagaggctctatactcgtgacccttgattttgggagttattgttggatcatttatgtctcccttcatattgttttggccctgaatgggcaggttgatacatgaaatgttgtttaagtcaggaaatctcctcccgttggggctgtaatgccattgttgagttgatgtggtcgggcttgcctagccttgcggccgggcgccatcgcgaccaggatttgggtcgtgacaagaaccttctgaaccattacgtgagcctttagtggaggagatagtccctacagacctatcttttcaccatgataggaaatctcttagaagccaggtttctggtttagaccgtgctaatacttaccccactcaaattacaaaagttttaactcctatagtccgtaaagattgccactggagtaatgattttcccattataatccctaatctaaatcagagaatcacttcttttatgactgggttctcttttgtttatacataccctttcactcttgggttcaaactagctattgacccagtgattcttgatttttgtcgtttcttcaatgtctgtctgggtcaaattggcccaattttatggagggttgtttcctgtttgaggcacctcaccaacatggcagatgtttgctttacttttcctcacctaattcacctctactcccctaggcttttccgcaatggcgtttttaccctagtagccaggagtaagagggttttggtgagccctgaagatgacaaggactgtggctggtatgcccgatttgttgctgcccccactgctggtttagtgggtgaagataatgttccctttcctgagaattggattttgtacgtaagtcttttgtcgttctcgtgcctttttccttcaagtttaccattttctctaattttgctttcttcttctttttagcaaccatgggagttgtggaggacgttcccaattttcgtggttgggtagataagttgctgaagaccgcgccagtggagggtaggtcttggaaaacactttccaaccattacggttggaaagtaaagactcatagtaagagtttttattttatctttcacgtgtgtaaatgttttcctttattgttctaacttgcatccttctttttatcaggatttgttattcgaggggttactgctgaagcagttgcggcctctcgtgcctcttcgggaacccatacctctttgggacctcgtatttctttagaaagactcccgagacatagtcttgggttcttcttccgcaaaaaggaaagttgttgaagaagaagactccgaagaagaggatgacgggggctccctggtgacaagaccacgagctaggagatgtatcgtctctgatgacgaagctggagtttcacctcgtcttcctgtttatctctccgagcccgttgaaaacccagttataattcttgacgatgacgtcactcctcacgatactcgtgagtcaattgatcaacttttcattagtggttttggtagtggaaatttagggcctgttttggatgaaattcccttatcttctttttcaactcccgtgcctgtgattccttcctcacctgctccagctgtttctgttcctccctctactgttttcacttcttcgatcgctcctcctttgacaattcccccacctatcgttcatcatacggaagtaggctcttcgagtagaagtgctgctatgaggagcgtaactattaaagttcctgctgacagtagccttttgaggaaatcaggttaagcagacgtttggctcgagcctttaattggcccaatcgaaaaagcaaaaatggagagccatagttgcctgactctaatgaatgacatagtgtatgccactttgaaggtattttccttttctctcttctttacttcgtaaaagtttttatctttgggtttcttatttcccatctttttttaggccaatcttatcggcacggaactgatgaacataatctccctcttggagaaggtagcacgtgattcagagaaggttgcacgtgattctcagttggaagcaatcaattggaaggaacaatttgatagtgcacaaattgagatggaagacttacaagagagcaggagtaccttggagcagcaggtgcgggctttaacctcagagttagcattcataagagctttctcaagccaagcagaaaaagaaaaagaacgccttgagtcctccttctcagagcaattatctaaggttagtgaggagaacagagcattgaaggctcttctgaatcaaaaagaagtttatgctggggggttcgtacaaagcttaactcaagcacaagaagaccttcgagtctctgctgataaggtgcgtgctttagagagctctcatgcctctcttcaagcttcttacgattctaccttggctgaaaacgaggagctaaagaatgagattgctgctagggaaaagaattatgagacccttgaggagcaatctgctgttgaggtgagttaggaatttttgaattcacaccgtgataccttgatcgaagctagccaagaaaactttaacttggaatccgaattggctaaagtcaatgaaaccatggagaaagctcagcaaactcaagactttccttttcccgtggctgaagcttccatgaacgttgaagctgattctggtatcgcaactctttcaagcccaatcgagcatgttgcttcgagccaagttgagcccgcaactgttgatgcacctgcccaagttgagcccgaaacggttgatgctcctgcttcagttccacaaacttcttagtgaccagttttcatcaattggatgacttagttttttgtttttgtttttgtttttggaaaattgtaatcaagcccttggcttcatttgagggttgattttggaaacataagtccccaagtcttttatggggcaatctgtataaacaatttcatagttttatgactaagttcgtacttagttttcagtttttaagtattaagaagttttttatgctatcatcttaaacttctgtttgtcttattcttgcctttatttttaaggacttatagaataatttgtatttttgttctttgaaaatgcttctattattctcatgactaattaaacatgagttttataaaagaggacccttttatatttcgacacttaatgaagaagacgtttcaacttcataatggtgttatcatacgataaaagaaataggaacacacatgttttttgaaataacattgataagtttttattcttgaactttgacaagttttgaatagtactttacatgaatttgaattgcatctataactttctcgtaactatttttcttgtaatagattttaaaaaaaagaagaataataaatacgaggtttatccttgtaacccgtttcagtacatagcctttaccctaactatagtaaggttttctctggccttggctcgtgacttcgtgacttttactctgcacttgactctttcaggcttgatttttcctcaatcttctttgccttctttatacacatgtccgtgtatattatgtagtcccccaagtgtttgagtgttgaagtatgaagcctcgagcacttgatagtttctctcatctggtcctttttactgaaaaggaaaaaaatacgggactcggaggtgcgattatagatgaagactgcttaacccgtttgtatttctatcagaataattgtaaccctaggccaggaattttagtttattacgttatgccttacatgtcgtgactcatcatttagtacgggttagcgttttgcctatcatctaaaatcgttagtaaaattttaacaattcaaaaataaattttaaaatagtgatacctgaccgtgggtattccttagaaatagtatctcttcaaatgaacaacattccaatgtgaaggtagtattttcctatccattgtcaccagttcatatgctccctttgctgcaatatcacgaactctatagggtccttcccatgttggacttaattttcccgtgttagcggcctttgtagattgaaaaacctttttgagcacgaagtccccaactttgaagaatctgaggtgtgcttttcggttgtaataaatcgttctatgacttgcttttgtgctgccattcttattagtgcagcttctctccttccttcgagtaaatcaagattgacccgcatctccttgtcattagattcttccgtcgcctgcgtgaaccgtgtacttggttctcctatctcaactggaatcaaagcctcagctccataaaccaatgaaaatggtgtttctcctgtactcatttttgtagttgtacgatatgcccataaaattccaggtaacactttaggccagttaccttttgattcctctaaacgcttctttaaattgttgataataactttgtttgttgattctgcttccccattacccaccggatgatatggtgtagacgtaatccttttaatttgccaactttgaaagaattccgtgatttgagctcctataaactgagggccattatcacatacgatctcctttggtactccgaatcggcatatgatatttcgccaaataaaatccttgacttccttttctcgtacctgtttaaatgctcctgcctctacccatttagtgaaatagtcagtgagtacgagcagaaactttacctgtccttttgcttgtggtaatggacccacaatatccattccccatttcataaatggccacagtgcaatgactggatgtaataattctgcaggtctatgcatattgttaccgtacctttggcatttgtcacatttagatacgaaacattccgcttcttcttccattttaggccagtaataacttgccctaattaaggttcttaccagtgatcttcctcctgcgtgattcccacaatgtccctcgtacatttctctcattacgtactccgtttgagacggtccgaggcatctttctaagggaccaccgaacattttacgataaagattcccttgctttaaatagtaccgagcagccttttttcgaagtgcatatgtttttttcttatcatcagggacggtaccataccacaaaaaagcgacaatttcgttgctccaatcccaagttaagttattgaaatttacctcattcttatcgggatcgagaactgaatgaaataaatgtataactgaagcatttgtatcgcttgccacgtcagctgtagatgagagattagctagggcgtctacttcaacattttcatcccttggtatttgtgcaactttccatgtttgaaattgttttatcaattcccgtaccttttctaagtactgatgcatccttgcctctctagctgtgtaagtccccagcatttgattaaccacgagctgtgaatcacttttgattataatctgatttatgccaagttctcgtgccaattctagacctgcaatcacagcctcatactccgcttcattgttagttatagagtgacatttgatagcttgtcgaatggtttcacccgtaggtggtaccaaaacaatccctaaacctgcaccttttatattagatgaaccatcagtgtataaggtccaagttcctgggttagctccgttgaacacctgcaattctttttctgcttctaattgcattccttggctaaaatcatccacgaaatcagctaatacttgagattttatagcagttctaggttggtaggtgatatcatattcacttaactcaatagcccacttagctaaccttcctgacaattcatgcttatgtaatatattgcgtaatgggtaagcagttactatagcaataggatgacattgaaaatatggtcttaactttctagatgccatgattaaaacaagtgctagttttttccaattgtggatatcgtgtctctgcatctaacaaagatttactaacatagtagataggggattgtttaccttggtcctctcggactaaaacagcacttaccgctacttctgaaacagcaaggtaaatgagcaatctttcccttacctttggtttttccagcaacagtggatttgataaatatgttttcaaattcctaagtgcttgctgacattcctcattccattaaaaatgatcttgctttttaagggctgagaagaatttaaaacatttctccgatgatttagaaatgaatcttcccaaagctgcaattcttcctgttaatctctgaacctcttttttgtttgaaagcatatcagggatttcttcaatggccttaatctgtgtaggattcacttcaataccacggttagaaataagaaaacccaaaaacttacctgatgcaactccaaatgcacatttttcgggatttaacttcatgttaaatttttgcagaatttgaaatgtatcagataaatgaaatatatgatccctagaatgctgagttttcacgagcatatcatctatatacacctccatgatttttcccaaatgttcttggaatattttagtgaccagcctttgatatgttgctccagcattcttgagaccaaaaaggcattactttataacagtaagtccccctgtctgttatgaaagaagttttctcctcatctactggatccattttgatttgattgtaccctgaatatgcatctaaaaaacctaatagctcatgccctgcagtagcatcaattagttgatctatgtgcggtaaaggaaaagaatcttttggacaggctttgttaaggtctgtgtaatctacacaaactcgccgcttaccattctttttgggaaccacaacagtattagctaaccaattaggatactttacctcgcggatagacccaatctttaataatttttgaacctcatcttggatcacctgatttttgaaagctccttgctttctcttcttttgtttgattagcgtgtacgatgggtcttcatttcctccggtggtattcctgtcatatcagcgtgggaccaagcaaaacagtccacgttagcttttaagaattctattaacatacctttcatatctgggctcagattagcccccacgtagactttccgttcaggccactgttcaaataatactacagcttccaactcttcaattattgttttgatgttttcattttcctctggctcttgaatggtatctggccttgaatccacatccgtttgcccttgtttaacggaagtttgtattactacctccttgattggattctgtagttgcaatatttctttatctcttgaatctgctacagaatttatgctccttgatgtatgttgatctccacggatttgacatattccccatggtgatgggaatttaataacttgatgtaaggttgatgggacagcatccatttcgtgaatccatggtctcccaaggatcatattataggccatctcaatatctacgacctgtaacttagtatctttgataacaccttctacaaaagttgtaagtattacctctccttttgtttgtcgcgccccctttttctatggcgaaatcgggcttgtgacacttgggaggaaaacttgttcccttttgggaattggggtatggaatttggagagtcgccacctaatgattaaagtgcattaggacactaagaagggtttgagttgaagaaaccagagttcgggtaagggctagaaattatctcgaggggaaggtgttaggcacccctcaagatccactagtgtggtctcggccatgttacaattgtgactttacaaataagcaattaaggctcaaataaagggagttcttacataattttgtaagtaaattaaaagtttgaagaaaatacagaaggcagaaattttgaggaaatgatttttaataagtctgaaaataaacataaacaagtaaaggaaagggggtcctaggtttatcaataatatggatcacatcaatgcaatacccagtaatcactcctcaaaagaggggctacatgaggtattagcgcaccggtcatcatatccatatctaccctttcccaccccgttaaggtattaaagcgcagaatggtatcgttacttattgcatgctattacccgtcccaatcctatcagtcccggaggtatttgggactactaatcctaaaaaggaaggagttgtgggcttttcagagtttaaaaaggataaaagtctaaggcgacaaacaaaaagcatataagacagttaagggaagcacgtaacagttaaaaggctcaaatagacctccttaaataaaaaaaagcatatattttagcatgtcttacatgtactgattaggtctgaattaaacttaagtattaaggcaggctggttcatcacatattttcagataagaagtccgaattaggcctgcatgctggttgtaattaccaaagactgatacaattatagttttaccctaaaggttgcctaggtgttgaacgcaacctataggcatgatatctatgagtttcagaaaagaagcaaacttattgcagaaagaattgtcaattacagggatataagttctgcaggcgttaaacgttattgctactgattttaagcgagttggcgattcaggttcagttgatagctcctataggcatgctttctaggtgttactgatttttttctaaacattgttattgtttatgcataaatcctatagacaggtcatctatatgcagttagttatttaaatcttataacaagtttgcctaatgacagatgcatgtgcaaaatgcagaaagtcctataggcatattaactatatgatatgcagaatttcagaagcaacttattggcatggtatctatttgaaattgtagtaaatcctatgaacatgatatctatatgagatgaggaaaatcctatgaacatgatatctatatgagatgaggaaaatcctataaacatgatatctatatgagatgcgaaaagacctatggacatgatatctatatgaaatgcggaaattttagaagtagtaattccctatagacatgatatctatatgagatgaggaaaattctatgaacatgatatctatatgagatgtggaaagacctatggacatgatatctatatgaaatacctatgaacatgacatctaaatgcagagattttagaagtagtgatttcctatagacatgatatctatatgaggtgcagagtttcagtaattatctatatgaaaatgcagcatttcattaattccctatagacatgatatctaccccttttgcatgcatgattgacccccccttttaactaacaccccagcagtttattacaagattattacagaccagaattaatcaagaaaaagtaaaaaatacatccgaaattaaagattccaaccaaggagagcctaattcagactcctagtctgacatgtgtagtaaaccaacttccaaagatcagattccaaagccttctcttatttgggatgtgtcaaagttccaaggagcttcaagagctccaggcagtgcttacaccccaaatatcattgcagaattgaattagtgcagtgtggaagagccagccctcaaatgtccaagttcagagggaactcaaggtcccaaggcaaggctcataggaggggggcagaacttagggtctaagagtaagtgcaagtgcaggggaggggaaatgccaaactggtggtcatgccaagcaatttggagtgctggcacacccctgaccagcttgtcattttcaaattgaggagttaagacctgttgaaggtcaggttcagacctggacaactatttgaatgctgccagaccatgaactttaactcagcatacataggggagtagggatatggggttcataataggagcagaatacaaggaaagagtaggcaaagggtatgctcagcaatgaaacatactggcacaccattcagcttacctggggtcaaaatttagttcatggacaacaattcatgttgccatgccctgaatccccacttataaacatatagagggtaatgggatagggagcaagtgtttacaagaaagtaaagcaagcagtagcatataagcatttcaatgtcaaattctgcaggaagtagacatagatataaagaccataagtaaacacattgggatgatgctgggaattgaattaagacatactagttttaaagagataaacaaagagaaagcaggagtcttgtgaaagccaaagtgcagacaagaatacttttaagtgaaaattcagcagagattgtgaaaattgtaagtgtgaagtctgaagtctattcagttgtgttttgtgaaaaagagggtcgggtatttatagtttgaaaataggtagaagtaaagggaagaatcatagtaattatggaactatgtaccaattacaatcaatcaacataagaacttcctttaattaaggagtttaaactcaaacggtaatggacagaaatcacttaaggaaagaaatcaagtaaacatcttgtgtaaagtaggaaattaagggtaaatacataggggtttaactaagggaagcattaataaagaatctttgaaatacccggttagccaaataaggtaagaaacacaataaatcaattagtacatagtaaatcaaggaatcagggattcgaaattaccaatgaaccaagtcagaaataggggaatcgaaaggctaaagaaagttttcaaatcaaacaaggaaagaatcaatcggacttaaacaaggaggtctgaaatcagtccaaaattgaaagtcatttcagagggccattcagcgtatataaagagtgcacaaacattaggcatgcgaggttaaatcatggcaaagagaaacagtaactaagaagtctatagatagtgaaacatggtagtcacataggtggatttagtaatagggagaagggggtatcggaagcatgccaaagagtcaagtaaagggcccttctggaaagtatagtttagttcaaagattacaataaaccaaatcacatagagaaacagaagttaaaacaggaaggactttgaatccagtcgagcaacttcaaatagacgaagcagttctcagaagctcgaataggtccaaaaggattaaggctttgaaatcaaacaaatttagagatgaggaccaagcaagtcacataccaaataacctcagaactcgaatgaaccccaaaccttagggtttttgccatcaatcgagtgtagagatgaaagacaagtaataaagcaaacactatcacgaaaacattcagaaacctcaaaagaaactaagattctcgacatgcaaattctagaacgacataaagagacacagtaaaggggaaacacataagaaacacagtagaagtacaacataagaaacacggtagaagaacaacataagaaacacgatagaacatgttaaaaatcagaaaagctttgaaataacttagcaaaaaccctaaatcggaaaaggttttgaaagcagagttttgaaggatatcagaaaaatgtttagaaacttaaggaaaacacagatctacaacggatctaaaagaatcagaagaacctcgaaggtttagggtttcagaagaaccccaaataatgagaaaggcttggaaagtcatgatctaagcaggagacatcaagaccaggcttgaatagccatggctggccggagcaaggtcggagatagccaaagtctggagcaaacttcttcaaggtttgacattgaaaccagggtaatcaggcgtgtaggagtcacatgaggtagatacaggccatcaatggctttgggagccatggatttggtcgattttaggtggtgattgaaggtggcggctagggtttctgagagagattgagagagaagtgggagatggggggattcaagggcagctacagacgggaaatgattagggttagggggtgattgggaattaaaaaaggaaaggaaaacaggaaccgttgatctggaagatcaacggttgagattagagagggtaggtgggaaacgggtttgggtcggtttgaacggggcttgggtcagggtaattgggtctgagattgggtttaattggggttagttttaggccataattgaaataattggggctacattttaaatagccattttccctttttattttataaaaaatagtaaaaataattttaaaagcaaattaaaagcactgaactaattataaatatataaatattaattaaaaaatgaaaaattttataattataaaatactattaatcgtaaaatgggctataattgcaattatatgcaatttagctttaaaaataccaaataaatttataaaaatatgcaaaaaatcactttaattatattttggtgtaaatatgataataaaataagttattcattaaaatgataatcttgagaataattattggattttgtactgctaaaacagacaataaaatgattttaaaaatctttttaaaaaatggggaaaatactaaaacacttgggtatgcttatatatgcatatatatgttactttgaaggcattttgtatacaaaaatacataggaaaaattgggtatcaacattgttataacgctggaattgtcaaatccagacagagtatgcgcctttggtactaatttatcttcagcttgcatttcacgtagtacccttagtaggataatattcacagaacctcctggatcaatcaaaactcgtttcacattagtatcatgtacaagtaatgatattaccagtgcatcgttatgtggagataatacgccatctgcatctgcatcatcgaaggtaatactttcttcctccaaggcttgtcgcacccgctttccgtaggtaatagtcaccttagagactttattggatgccgtgtatgtcacaccgttgatatcttcccctccgcttataacactaacggtccttttgggtgaaggtggtttcggaggctcctgcctattcttcatataagcttgtttacctttttcactgaataactcggtaaggtacccttgttttaacagatgatcaacctcaccttgtaaaaacctgcattctgctgttttatgcccgtggtcattatgaaactcgcaccaatggtcagggttgcacctgtttggattcgatcttatctctttatctgatgaatctttctcctaatattaaaacctagtctgatgaattttctcctaggataataatttttttttataaaaaaaagaggagtctggatttgaaaaataagggtcaatttttagtttcttaagttattaatctttagttttcttgaaatcaggggtccctcctggagaatagggtcagtttttacttaagtcaagcttagtttatagttttccgcaagctcaatcttagatctaggagacgcacttcctagaccgggtcattcaggtttttttaacagacgcatttgctagtcgaaattttcttggttttactcacaggagacgcacattctagccgagtcttcaattgcatccttcatcaatagcatatgtgattcataggtctgttaacaactcacaaatcttcctagtgcaaactggggcagaaaagtttcttttgttttgtctgttttgctgtagtagcaggcgcccaactggagaatgagggaagtcattttagaagtcaattcaagttagaagtagaggaagctcgcctcaaaaatgcgagtcgacagtccgagataaccaaagaataagtctcaatccaaaaagaaaaagaaaaaaagggaagtgaatccaaatgcagaagcagatgaaagacgtgaactgcccaagacatggctcaagtcacgagcactgcacgtccggtcttgatccgaagaagccgtgaaagaataaaccaacacctgcagctaacaagcatcaagattcagatcagagtccgcatgaagaaccaaccaagactcaagatcaagcttcagaagactcatagataggaatcttgtaactcgtagctgataggcttagttagtctttttaattttgatttttgatgtaataacatgaccacggaccggaacctcgacggaacagaacctcactcgactctctcatcctttccacatactccatcacttcattcacatctgaattacacatggcctaattcctttatagccaaggatacgtaggcagctcagataccaggactcggtcacattctcctttcttttagtttttggtctctctaaataaggttcgggtcaaaaaacctgtctcgtcgttatatgtttgaaaactcttcgtgttttcagtcaaagaggggcagctgtagagatgtaatttttgaccctccccaagattttacacattttagaatttaaatatttagtttaggtctaatatcgttattttaactagttttgacccttttactttattttatcacaaaaataaaaattataaaaaatattttctcttatttagctaaatgatatattatttagttacttttagtttatctacctttcataaaattcaaaaatacaaaaatagttctactttgttttcatgaatattagtagtttggtaggaatattattttaattttgcaattattttaatctaattccatttttatcttttagtatgatatttgaaaaataccaaaataggtttgttttaacgattagttttatttaaatagttatttacttaaataggattaattagtaaatgggggtagtatttttagtcttgttcaaggagaaggaataaaatttgggctcgaagaaattattttttaggcccaattttcagacccttagctcataaatccaaaaacaatacccataaaaccctaacccttaaagagaccccagcctttttttttattatgatctgaacccttacacaccctaaggatcttcttcttcaacctaacacaccttagaaccagcgagacccacaagaatcgacaccccactgcacctccccaatccctcagtcttgctttataatataaaattaggaataaacaaatctctacaaaacaaccattgggaataagaaaatgtaatccctaaaagtaaaaaaaaacagatccatccccaattcctcattcctcacgaatctgctgttctccaccggcgctagctactagttactccgagtccgagtcatgtggtctcgtgggtctgtagttccatcgtattttgggatatcaggcatcttgaacttctttgaaattgggaggggagcaacacttggcttctagggttgttgtgaatacttatccatatccacccctttgattacaggcggcaccccaggtatttgctctatgcggtcattttgctcctagaactgtttctgcaatgttagtattaaattttgcaaatgagaattaactgaattacctggttctctctcctgtgattcactgggggttccaccatttcctgaattaacaagcccggaacgaggattctccaatgtgttgttatttggagtaggcgtgggtggtgcagcatgtaaccgattaactagagcctgaacagctttattgacatgtgaagcaataacttcttgcaaagcctcatccacaacttcaacattttcagattgagcctgtccatctgcatgagatcccttaggagtaccttcacgagatctccgaggaaagcctagtggagaaggaatcagtgcgttattatcttgcagatctccatgaagttgttggtttatttggttttcttgggtgtttttgttgttgttcgacatggtggaagcaacaaggaaaattcaactaaagagaatagattatcaaagtcccggtaacggaaccaatttgtttaaccaaaaaatatgattctagtcaaagctaagaattttgaagaacgcgggttactgataatcgaaagaatttaagtaaaaagagatttagctagaaatagtataatcagaagaaaagcaagtagaccaaaatatattcagatggtatttcgtgtccttacaattgtctattcctctcccttttatagttattttggggatatgtgccttacctttgtcataacaaggctattattggcaattactgacattaaatgctacgttacacaattattacattaaatacatattctctaacgttttcagtttttaatacccattaaatactgtatttggactctcatgtgctgtcagatttattcccttgattcttcttgtttcttgaactttaaatgtcttgaataggtacggtcgctgaattacttgaataactgcccgtgcctcttccgttacctttgctcgtatccgttgctgctcgtgtctcttggctaattataattctttgaccatttgaccagtctaagtgtcatgatcacgtcatctccaatatgtaaactcgattttttccaatacacttgtatctaatgttgttgatcacgcttaaaaatatggaaggagatatttgtgtgtaattcttggagagaaagattctttatttatttggatttttaacttttatatatgcttgatagttttggtaagtttatgattaatgactagaggttggtaagctaggatttatttggaatattatcttaatatttccataaaaaatgaatattaggtctagctttgccccaaaagttaactcagaattgcaaaagactatttaacgagacaagtccccatcccgctaccgagatctggactcaacaatttgacacgactattcagtttgaattataaattttgcatttgagtttggataaaattgaacatgtctgttgatgaagagaagtgtctatgtctattccaaaaggccttgtttttgctctgcaaataatagtttttcctacaaaattgtatcgaaaaacctgtatgttatgatattcgcttgttatatcctgaagaagattgttcatgatttactcaattagaatacatgcaatattgttctcacacctcaaacttttcttgttctcgttttcagattactaaattttctatcaaatcatttattcactagagtattaaacgtagaagaaccattaattacaaataaaataatgcaaaccataagctaattaattaatcacaaataatcggatattcgtcccagagaatttaacaataattccttctttttaaaatgaaacgaatattttcttggtaatttgagcagtaaagactgcatttttgaatgatcaaataatcaaataataagctaatattcatgctttaattctttattggtaaaattcagattctgtacgtagcacggcaaaataacaagacgtgttcatgagtcctctgctcaggtttagattaaacaaattcttctgcatgtaaccatgcatgtggccaggaggggcagttgtgtaaataacccatataagaggggctactaattagtcaaagttaaacacgaggtgggagaggtcaggtaggtataaatgggcgccaaaccccctacaacctaaaatcgtctgcttcctttatctcttcaaaatttataatactgtattgaatatccagatagttatagcgtgcatgcaatcaaacactgccctaaaaaatgaaatggaacgtagtaacaaagaaataattataaaaagaaaagatataatataatgtcacttaaacataaggatgaaaattatattgcaaacgtaaacaagacaaacataattaagttctcagataataaaaacaaacatgatgtttagctaaaaagttatttaatccttcttaagcataaacaattaatgaattaagggccaatcatagcagatcgtagtaaatgaccaagaaaaaggaaataaagaggcaaaacgcaaagtttatggttaaacacagcgagaatggaaagttttattatagatctttatcaagttggtctgcctctccgtggagaggttcagagccttacaatgattctcctctcttttagagagagaatgtttttaagaagaagaagcagcccccttttagggttttctctctttgtatttatagttgtaactctggccagctggcgctggggggccgtgaccacatcgaggagatgtccccatgaggacaggtgggccgtagtctccttaatcaaatcggatagttaccagaggaagctgttagtcattaaccgtatagtattagccgtaaacaacgattagagagtgattagtcgtattaacgattatagagtcaaattctgacccatacagatagtccctccgcttattgaggtcgtgccctggccgagctcaatgggcagactatgccgcttataccttgagaaacttggaggtgaaggtcgttcactgccttcgtaagacagccttagctgcaatggagtcgacggctggaggtggatttatatttgtaagtagtgatcgcgttctttcggaggtgcttcccgttaaagcgtgggggacggccgtggccgttagtgtaacccaagacggccgtagtcgttaagccgtctttgttttggagatggccgtaccctcgtgacgtttctagagacggtcgtggccaccgtttattcagaaatggccatagcgagatattattttcaaagacggtcatagccgttgctaacctagaactgaccgtaaccagatattgtcctttagagacggccgtagctaatgccgttctttgggatccgtgagtgggtcgaggccgtgcttcccgtcagagcgggaatacgtacgtgggaatctttctgggcggctcatggccgcaggccgtctgctggtgagtatatttgcttgcagtgtcattccttagtttgcattttgcaatttcttctctaactcttcccttttcggtggttagggcaacctcgtcgtgtgagggctccccaacttgtctttcgaaggccgggggcgacttcacggttggttgcaataccggcctctcgcccagtcccaagggcggcttcagtcgaatcttcggcggctccttccctaatgcggcccgtgtataaagttgaagagtcttcgggggtcgtacgtcccagggcggagttggcgccaagtgaagatgaggaggaggatgaaaggccgctcgttcgacgcagggtggcgtttaatccgtcccttccagtggtgatcagtttagattctccgccatcagaagcggagggaaatgcggcggagccggctccagagggagatcgttcgttgggggttgccccggttggcttaggccatgttgatattgtcgcttcggcgatacaaattttaactccggttgttgagggagaaggtggttccccggcagctgtgttggtggaggagacgaccgttcaggctgtggtaggtgttgctgcttctacttctcatgcagcggaggcctcgacttccagggcagcggaaggaaggggcgcctcaggtgaaggcggggattcagagtctgacctggattctgaggacgttcgtctgtttcaagagggctttactcgccctgtggtgccggcgcaggggagttttcgttatattgagatccccaatgatcaaaacttgccgctccaggaagagaacctggtgacactttttgaagtgatgagttctgaggcagagagcacgtccgtgcagggtatttcggacgttggtttgatgggcgaggttgcctcccagtgcataaagatacggcgaatcactggtcgatttctctctttagtacctttctcttatactgactgttattccatttattgcagtcatttgtaatggaagtggagagcattcgtcgagccaacgtccgctcggcggtctttgttcgtttgttggagaagtatcgccgttcctgggacgacgatgcgtgagcgtctaaggaacgacccccggagccgggacctagtcgaatagttggcaaggcgggagcttcacatgcagcagactcttggcagggtaaacacccttgaggcgcagcttcgtcgaaaggacgaagaaatggaggtcgagaggagggctgccgctgatagagagcgccagaatcaggcggcgtcgatagaggtcgccgaggctttgattgggcagacggttgctttggaggcggaggccgctgctttgaggcggcaagtaagggacgccctgtcgagggccagtgcattggatgcggcgatcaacgttcatgagaaggagcagaagttggagagatctgctgcagcctttagagaggcagagctggaggagcgtattggcgttcatgaacaaaatgcccaaactgcggcagaccggattacggccttggaggccgagaatcaacgcttaagggatcaggccgcctctttcggccctgcccgtgacctttggactttcgctgaagctcagcttcatgtgtataagaggttgtgggaagctggcgttgttcctgtgactgcctatgaagaagctcgccagagggcccgtgatgcccgtctcgactgtggctttgatccatctactcctggggttgaagatggcgccgagggtgcagacaatgttgatgatggcgccggtggcgccgagtgaaatgaaaaagtttgtaaagtttgtttttgtttctattctcttttttcttttttttgttttgattggccttgggccgtttgtactcgggggtaaccccttgtaaatatttatgaatatatgcgactttcttttttcttatttgccatgtgttaatctcgtacatttttcttgttcctttcgcactcgctcgagtggtcttgccttagaatttttctagcgggcatgtaaatggccttgaccagttgggtgatttcgaccgttgtcgaattgatatgtaaacggctttggccgattggccttagtcaaaagttaggttggctattagcgtcgatggtctcggccatgattagacgcttttgatgtgagtaagttattgctcttgcttggcggtggcggcatataaccttagtcccagtcgggcttggttagactaccgaccgtggtgatgagagacacggccttgtagtttagcctgggccaaactttgcataggtaagaaactttttagctcgagttagtcgtacttacttgagcagcgggggcccatggcctgagttttgagtttgactatgatcgatcgttttgagggcgtcatgcctcgttcgtgatttggctcacaattggactgacgtgcattcttgtcctggattcggtctaggctgagtttgagcccgaattcaactcgtggttgatcttttagttggcctgagtttgagttccactcaaactcgtagttggactttgtaggtggaggcgcgtggcctgagttgatgttcagccttagttgaactttttgcatttctttagcgtcgaaggcactcggcgtgagtctcggttcgactcgtagttgaatttcgaggcgaaggtacgtagcctaagctggtgttcaatcgtggttgaactctttgtgattttttttgatgtcgaaggcgcatagcctgagtcccagttcaactcatagttgaacttttgggtgaaggcacgtagcctgagctggtgttcaaccgtagttgaaccctttgtgatttttttttgatgtcgaaggcgcatagcctaagtcccagttcaactcatagttgaacctttaggtgaaggcacgtagcctgagctggtgttcaactgtggttgaactttttgtgattttttgatgtcgaaggcgcatagcctgagtcacagttcaactcatagttgaacttttaggtgaaagcacgtagcctgggctggtgtttaactgtggttgaactttttgtgattttttgatgtcgaaggcgcatagcctgagctccagttcaactcatagttgaacttttaggtgaaggcacgtagcctgagctggtgttcaactgtagttgaaccctttgtgatttttttgatgtcgaaggcgcatagcctgagtcccagttcaactcatagttgagcttttaggtgaaggcacgtagcctgagctgtatttcaaccgtagttgaatcttgcattttttgatggcgaaggcacatagcctgagttgtatttcaaccgtagttgaatcttgcatttcttgatggcgaaggcgcatggcctgagtcccagttcaactcatagttgaatttttaggcgaaggcacgtagcctgagctccagttcaactcatagttgaacttttaggtgaaggcacgtagcctgagttggcgttcaaccgtggttgaactctttaggaatttttgaagtcgaaggcacgtagcctgagtcccagttcaacacacagttgaacttttttgaagaaggcacgtagcctgagtgggcgttcaaccgtggttgaactttttagaaatttttgatgtcgaaggcacatagcctgagtcccagttcaacacatagttgaacttttcgaagaaggcacgtataggctgagttgtcgttcaaccgtggttgaattctttaggaatttttgatgtcgaaggcacgtgtcctgagtcccagttcgatacatagttgaactttttgacgaaggcacgtagcctgagttggcgttcaaccgtggttgaaccttttaggcacttttgatatcgaaggcacatagcctgagtcccagttcaacacatagttgaactttttgaagaaggcacgtagcctgagcgggcgttcaaccgtggttgaaccttttaggcacttttgatgtcgaaggcacatagcctgagtcctagttcaacacatagttgaactttttgaataaggcacgtagcctgaattggcgttcaaccgtggttgaactccttagaaatttttgagcaaaggcgtttgtggttggttttccagccgtggatctttgccctgtttgtgtgtattcttctcagataattcgtagcagttgctctgttgcagatctcggtacgagatgcgctcgcgttgtttttggcaagatcctgtatcaggggggtggtgttacctcatacgtgttatccccgtaggggggttggtcttcttcttcttctaatatttctttgggagtgaaggatccgagttcttgttgaagctcgtgggttccctctatctgccatgttgctgtagctcgttcgagctgagtcgttttccctttttggtccaaggatgaactacatgattctgctatgaaatccccacatacggcgccaaattatttagctaaaaagttgtttaatccttcttaagcataaacaattaatgaattaagggccaatcatagcagatcgtagtaaatgaccaagaaaaagaaaataaagaggcaaaacgcaaagtttatggttaaaacagcgagaatggaaagttttattatagatctttatcaagttggtctgcctctccgtggagaggttcagagccttacaatgattctcctctcttttagcgagagaatgtttttaagaagaagaagcagcccccttttagggttttctctctttgtatttatagtagtaactctggccagctggcgctgggtggccatgaccacatcgaggagatgtccccatgaggacaggtaggccatagtctccttaatcaaatcggatagttaccagaggaagctgttagtcattaaccgtatagtattagccgtaaacagcgattagatagtgattagtcgtattaacgattatagagtcaaattctgacccatacacatgacatgaccatccatatccataagaagtgaatggagatttctgatacatttgttcttatttccaacataaaactaaatattatactatactagaacgcacacaaatcagcatacatcttcatattcctaggtaattagttgtgaggcttagcttcagttactttatccaagtcttcatttcctcctccaaatccagctccattttcattactagtgttatgatcgaaaaaatcaggtgtcatgcgaaaactagcaaagcaaaccttgaacaacgataaatcagacaacaaaggagtaatctactaaaagagacacaaacatgtaacgtggttcggtcaactgacccacgtccacaacggatatgagcaatccactatataaaagagagtacaaaatatctcgagaaccaccacgcgaagaggcaaacacaagtgacacactaacacttgtcccgtaagttctcccccctaaacacgactctcaaaccccatatggctacattgtggatgatgctgaatgagaagggcgggcgaatcctcaatttatagaactcctaaccttttcctacaagaaaagggactagccaaatatggaagaattatatattcttactaggaaaagaaaaactcaattatggtaaatatgttatcctttccttcatgaaataggaaaaccaattatggtaagaaaatctggacaaacacctaacaatcaggatatgctccgccacaatatcaccatatcctcctccacgagatcctcctcctcggaatcctccaaatccgcttcctccagatcctggaactcctgctcctagaagtttggtgtcattttcctcatttttcttatcggataacttttttgcaagaatatgataatcatgcatatgcatgttaggttgataattagctacgcattatcaaaaacattattatctacggaagatttagcgatagattagggacgaatttagtagctaattcctattttttttggtagtagactttttagataaatctagttgttaagagcagaagttaattaatgcaaaataaatcaagtccataatgaccataaaaacaagaaaataatccatctttttgtgtggcgttgttaataatttgaattttatgagttcatgttcgggacgttgctaccggactcatttaatttattggatttaaaatcaatattttgcacttgttttataaatcatttaacacatgtataaggttctagtgaagctacttggttctgataatcccatataactcacactacatagcccatttgtttggctgacaatgaagttcaagaaggaaaaaaaaaagatttataaaaaataatcaactctaaaaaatactatcagagacttttttcctaattatcaaagtgattatcaaattaattatttttatatattgcatgtttattatgagaataacctatagctcattccaaaacaaatacccctgtggttcaatttatttgaacctattttcttattagtctgtaccaaaaaaatgattaatttccatatttgatatccttcactaatacttttatactatgtacaaatatattttaaagtagagggcctaaaacaattgctttagtggtttttcccatagtcggcctaagcacaaattactgcataaattgaacagttggtttattataaaattcaagttattcattccaacatatagatatacaaattttagtatcctttattaatgtaatgacccgatcagtcgttttgagtatttgcacttcgctcggtagtttacgggcatgagtagctccgtataatgtattatgacttgtgtgaatcgtcggtttttattttcgggttattcagaattgatttggaagaatgattctcaactagcaagctttaaattaggagagttgaccaagtttgactttttagttttttttacatcggattggggttttgatggctccattagctccgttgggtattttggacttaggagcatgtcgggattgtaatttggagatccgtagttgaatttggcttgaattggcgaaagttggatttttaaaaagtttgaccgggagaggaattttttattttggattcagattgtggttttgggaattagaaaagcttcgatatgtcatttgggacttgtgtgcaaaatttcggttcatccggggttggtttgataggtttcgacgtcaattgttgccttgttggtatgtttggttgagttgccgggggcttcaggttgattccggatgattttcggaacaagggttgaagttgtagagcagctgaaggctgctggttctagtgtttctgcatctgtgtcgttcgcagatgtcccgccccctttttctatatatatatatataggtcaaaatcaggcttgtgacatttgggaggacaactcgttcccttttgagaattgggttttggatttgaagagtcgccacctaatgattaagtgcattaggacactaagaagggtttgagttgaagaaaccagagtttgggtaagggctagaaattatctcgaggggaaggtgttaggcgcccctcaagatccactagtgtggttcccagccatgttataattgtgacttcatataatcaaataagcaattaagactcaaataaagggacatgcacacaacattgtaaataagttgaaacttttgagaaaaataaagaaggcagaattttgtgaaaatgatttaagcaattatggagaaaacaaataagaaagcaagtaaagggagggaagtcctaggtttttgatttatatggatcacgtcaatgcaatatccagtaatcactcctcggaagaggggctacatgagatattagcgcatcggtcatcatctccatatctacccttcccggtaggtattaaagcgcgaaatggtattgttgcttattgcatgctattacccgtcccaatcctatcagtctcggaggcattgagaatactaatcctaaaggatagggagttggagcttttcagagttttcaaaaggataaaaatctaagcgacaaacaataacaagtggcacataaaagggaaaacaaataatagttagggttcagataagcctcctcattcaaagcagcaaatcaattagcatgccttacaagtactggtttggttttaactaaattaaggcgtaggataggctgattcatcacatatttctctgatgaggagtccgaattagccctgtttagatgtagttgtcaaagactgacacaactgattaattacctaacagtttgcctaggtaaggcctataggcatgacaactaatagagttgtactgattttaagaaaagctgctgattttagaaaaaagggatctgcagattttaggactgattttagattccaaaacgaaacagattcagttaatttagtcctataggtatggtctctaagtgtccttgattttaacagttgcaagagtcctatagacattatctctaaatgaatttattattattagacctaaagttgttttcctagtggtgtatatatgcagaagtatcgaaagacttataggcatgctttctaagtgcagagatgcagaattgtaaaagaccctataggcagattttctaagtgcaaagatgcagaattataaaagaccctacaggcatgttttctacccctttacatgcattcattccccatccctttccactatccatctaaatagttattacaaaattattacagaccgaatgaatcacaaagaaagtaaaaattacatcagtggttaaagctacatctaatcagcctaattcagactcaaagatcaacaatatgagatagaccaacttccaggatcagatctccaaaagactttctcatatttggagtgtgtaaaagttttcaagagtctcaaagggactccgggcagtgcttaaaccccaaatatttcagaatcaagaacatagtgcaatatggaaaggtcagctctcagatgtccaagttcagagggaactcaaggtcccaaatcaaggctcaaaagagaggggaagaacttaagattctaggaataggtgtaagtgcacaaaggggaatggaatcagggagagacagggcaagctagtggtcatgcccagcaattggaatgctggcacacccctgaccagcctgctagtcaagcattgagtgttaggatccattgtggatcaagcctaggcctggacagtaattaggatactatcaggccaagagcttaactcagcacatagaagggaataggggtagaggattcataagaaagaagatatgaagcacaaattacagcatataagcagtaaagtaaacaagaagcctgaagctgtaaagtaaacacataagggtgaggcagaatatataaacaaaggacataccagtttcaaagaaaataagtaagcaaaaatagccttgaaagacccaaattgcaaacaacagttccaaatgatctcaagcaaagcaggattagaaaatagtattgccagaaaagtgagttcagtgtgtgagtggtgtattttcgtgtatttctaattgctgagaattgactgatgatagaaatagggaggactaggtccttatatagtttttaaaaacaattaaggcaggcaaagagtgcacaaacatataaaccaatcaattagtatcaattaagacaactagactcatttaattaaggggtctaggtcaaacgactaatcaagatagcttaaggaagaaaaaattagtttactaaggctgattagggtaaggaaaccatatagtgcacaaataaggtcaaatacattgttggtaattaaggaaaggtggaatagtagtgagaaaataaggtatcagtttgaaaattaatcaaaagaatcccggatcccattgtaatcacaaagctaaagtaattaaggaatgaaataattcaaacgttggtacagaatcacagaggatacacaagaccatgtatttaaggaaaacatcacaagcctaggatttttacacaaaaggatcaaaataaatagccagtagagtaaaatcgaaagaaatcagtggtgaatcactagcaagattaaagggatttcaaaatcaatcctgggtgaaatcttttgaaagggaagtttttcctcatatataaagaatacagttcaaacaaagaaaaagcttaacaaagaaaatttcagaatcacaagcaagtaggattccgaattcagttctaggctcacagtgagtctggaaacctagggctccaaagtgaaaccctagtgccatccacccaaagacaaaacccctaaattttagggtttcaaatagaatcagggatgagaaatcattcaaagtcattgagagaggcagacatacacaaacagaagcaagagaaactacgagttttaagataaaatgtaggcaagaacatgctgagcaggaatattaacgaaacttagtaaagtgaaacaaaatcaaagcacgaacttaaacatacatagcaaagagtgaggagcaatgacctaagttagcatgtgaacaaagaacagaaaagaatcttgcaaaatcaggaaagaaataagagaacaatcttgaacataataagaaataaacaagcgagcataaacacacataggagagagacaaagagtcagaaaacatgtagaatctttttccagaaaccctaaaaatcggatttgaacaattgtgaaaaggaaatttggggaaaagccctaaaacgtctattaaagaccaaacacgtcacagatctgaaagaaatagactagtaaagaaccttagaaggtttaaaaatggcagagaagaccctaggatgggaaggtcttgaggaaagtcggatcatgagccggagaaactcatattgctttgaacatgtcggaaaatggccggagaggccatggatcttgcagatctgagatagatctaaaggagaccatagaagtcaggcctccaatcttcgaatagcttaagttagtggtgagggagagtgagcacaggccatccatgaccaggattgccatggattccggtgggaatgaaacggagatcggtggaatagggttagggtatcggagggctagagaggttttggaagacgaaaggagtttaaaggcggcgtctttgtgcaaatgagttagggttagaggggttaggggattaaaaaaggaaagggtaaatcagggcagttgatcaaaatgatcaacggctaggattaaaaggaaatccggacgggtctgaaaacgggttaaggggtcgggttaaaaaataaaattgggtcatttaattggggtttaattttgggctaaaattgaaatgataataggctatgtgttaaataaccaatttctccctttttaatttttataaaacggttaaaatgattttaaaaacaaattaaaagaactgaactaattaataatatataaacattaatgtaaaagtactaggaataattttataattataaacgctattaatcgtaatgtaggctataattgtaattttatacaatttagcttaaaaaatatcaaataaatttataaaaatatacaaaaatcaccttaattatattttggtgtaaatatgaggatggaaataaattattcaccaaaataataactttggaaataattattggattttgtattattaaaatagacaataaattaattttaaaaatcataaaaattggggaaaaataccaaaactcttgggcatgcttatatatgcatacacatgctattttgaacgtattctgagtatacaaatacatagaaaaaaattgggtatcaacaactgcccctctttacctgagaaggatgaaagagttgtcgggtaaagacatgatggccaattttgaccgaacgatttgcgaagaattttgaccgagctctggttcttaagctacctacatatccctggtcttacaagaatcaggccatatgtagttcaggatccattgacggaatatgccgatggagattttcgaaaggaacggacgcgatgtttaggttgggaaaggtagttgaagtctgataggctgcgggaactggagcgggatcgctcctgttgagacggccattgatagccagtgtacctgcaagtgagcaatacaaacatatattgtgcataaatttaaacgtgatgaaagttcccgttggaccatgaatgctgtcttcggacggttaggatggcgtccttggaccatgaagtcctgggccatgaagcgtatgataaaggattcacaggctatgaaatgatgttctcgggctatgaaaatgatgcctccgaactatgatgcctttgaataatgatatgcaaaagatagaagtggggtcctcaggccatggcatggcgttctcgggctatgcaaatggtgcctccaaacaatgacgcctttggataatttggcgttctttcagcccatgaaatgcagaaggtagcgatctttcagccgtgcaagaaatataaagtggcgatatttcagccatgcaaaataaggtggcgatatttcagccagcgagaaataaaggaagtggcgatcttttcagccaatgcaagatggaggtagagcttaacctcggaaggcagaatgatagccttatgcaatgtagggaaatgcaaatggagacagagcttagtctcggaaggcagaaatgtagccttatgcaatgcagggaaatgcagatggagacaatgcttagtctcggaaggcagaaaggtagccttatgcaatgcagggaaatgcagatggagacaatgcttagtctcggaaggcaaaaaggtggccttatgcaaagcagggaaatgcagatggagacaatgcttagtcacggaaggcagaaaggtagcattatgcaatgcagggaaatgcagatggagacaatgcttagtctcaaaaggcagaaaggtagccttatgcaatgcaggaaaatgaagatggagacaatgcttagtctcggaaggcagaaaggtagccttatgcaatgcagggaaatacagatggagacaatgcttagtctcggaaggcagaaaggtagccttatgcaatgcagaaaagtaaaaggcggacagtagtaaaatctcttagctgatagctgattgcattattgtggctggtggggatgttgtgtacgaatatcaattgtaaataggtgatgattctgtgaagttgtattcctgaaaaagtatgagtgcatagatgattttgcgaattgaatgcctgcatccaaagaaaaatcgagagttttgtaggggggaaggtcagttcgtatcctcgtggacttcgctcgtcctgattggctccgtttttcagtgatgttgtgtatcattggggtacaattgctaaacagagcaattttgataatagacatgcatgatctagtaaaaaatatgacataaatatataatcaaaaatagttttcttttagatgaaccgacgactgcgacgcggttcaagacattgaaacctcgctcgctccggaatattgagggtcctcctcaaaattctgccccagtatactaggctggtgcttctgacggctgcttgctgtaagaggctgaaatcgacttcggaattttgagggtcctcctaaaaatttttccccagtttctgatggcgggggaaatggaaattttattgaattgtgaccgaacccatagggctacctatgtatcccctcttaaacgggaatcaggtcaggcgtagttcaaattacatcataaagaaatcataaatggttacacatagtatcgcttcactgcgtctgagttgattggcttcaaccagacttctccgtccatttctgaaagtatgagggctcctactgttagaacccgatgaaccatgtacggaccttgccagttgggagagaatttccctttgacttcatcttgatgcgggaatattttcttcaacaccagctgccccggtgtaaacttccttggcttgactcttttgttgaaggctctggacattctgttctgatacaattgaccgtggcaaactgcatttattcttttcccatctattagatctagttgctcgtagcgactttggacttattctggatcatcgagtttcgcttcttatatgatcctcaaggagggaatttccacctcggcaggaatgactgcctctgtaccataaaccaacatatggggagtagccctagttgatgtgcgaactgtggtgcggtatcccaatagagcaaatgctagcttctcgtgccactgcttattcttttctatcattttcctcagtatcttttatattattgttggccgcttctacagctccattcatctgaggtctgtaggttgtagagttcttgtgtttgatcttgaatgtttcacacattgctttcatcaggtcactattgcgatttgaaccattgtcagtaatgattgactctgggatgccgaaccgacaaacgatacggtcgcggacaaagtctgccacgaccttcttagttatcgtcctgtatgatgctggttcaacccatttggtgaaataatcaatttccaccagaatgaacatgtgctcgtttgatgcggaaggctcgataggtccgataacatccattccccaaacggcgaacggccatggcgagcttgttgcagtaagctcgtttggaggtacttttatcatttctacacgtatctgatagtgatggcactttcggacatactggatgcagtccgtttccatagtcatccaaaaatatcctgctcggagtatcttctttgctaagacaaaaccattcatatgtggaccacaggtccctgcatgaacctcttctaataacctggatgcttcctttgcttcgacacaccttagcaatcccaaatcgggagtcctcctatacaggatcgctccactgtgaaagaagttgttagataatctccgaagtgtgcgcttatgagtagcgttcgcaagttctggatattctcctattgtcaaatactccttgatgtcatagaaccacggttttccgtcggcttcttcctcaacatgagcacaataggctggttgatcgtagatctttaccaggatgggatcaatgaaattcttatctgggtgttgaatcatagatgatagagtagccaatgcgtcggcaaactcattctggaccctgggaacatctttgtgaatctcttcctcaactcttgtacatgatgcagataagggagtatcttagagttcttggttgcccattcttctcgaacctgatatatgagcaagtctgaatccctgatcactagcaactcctgaatgttcatatcaatggccagcttgagccctaagatgcaggcttcgtattcggccatatttttggtgcacgggaacctgagcttggaagataccggataatgctggccggtttctgatactaggaccgcccctatgccaactcctttgaaatttgctgctccgtcgaaaaacattctccaacaatcataggattctgcaatatcttctcctatgatagatacctcttcatcaggaaaatacgtctttagaggctcgtattttccatccacgaaattttcagcaagatgatttgccaatgcttgtcctttgattgccttctgggttacgtaaacaatgtcgaattcacttagcaggatttgccacttggctagcttgctagtgggcatgggcttctggaagatatacttcagcaggtccattcgggatatgagataagtggtataggcacataaataatgcctcaacttctaagctacccaagtcagagcacaacaggtgcgctctaatagagaataccgggtctcgtacgaggtgaacttcttgctgaggtaatagatggcttgctcctttctccccgttttgtcatgttatcccaaaacacaaccgaatgtcccatccaatactgcaaggtagagcaacagtggtctacccggttcgggcggaaccagaactgacggcgttgataggtattccttgattttgtcaaaggctttctgacaatcatcagtccatttggtagtggcgtccttcttcaacatcttaaagattggcttacaaatgatagtggactgagctatgaaccggatgatatagttgagtctccctaggaaactcatcatgtccttcttgttctttggcggtggctattcttaaatggccttaacctttgatggatccagttctattcctcggtgactcacaatgaaccccagtagctttccagcaggaaccccgaatgcatacttggcgggattcagcttcagattgtaccttcttagtttgttgaagaatttcctcaaatcttccatgtggtcagcgactctcttggatttgatgatgatatcgtctacatatacctcgatctctttgtgtatcatgtcatggaaaatagtagtcatggccctcatgtaaatggccccggcattctttaacccaaatggcatcattttgtaacagtacattccccacggcgtaatgaaagccgttttctcagcatcttcttcatacatccatatctgatgatacccagcaaaacaatcgacaaacgactacagctcatgcttggctcagttgtcaattagaatgtgtatatttggcaaggggaagtcgtctttcggactggctcggttgatatcccggtagtcgacacagactctacccttcccgtccttcttcggtactggcaaaatgttgcgttgtctcatcgcaagtcacaatcgtcggttcatcaagataagtaatagtaatgctgtataaataaagtaaacgatatagaaaataataagagcgagatttataagaaactgaaatgctttgataaattccataattgttttgaacattggatctcttttcgaaatttaaagaaaatacggaaagaaaatcaactagcgaaaaagtaaaagataatgtgtggtgctttgttcagccttgctaccccgaagctttccgggccctaatagttctgatggaccaattattgaggcgcgctcctcggctcacagcttgtatggaagggccttcctccccttcctcctcgaaaatgacataacagtccatgttgtcgtcttccaaaaatagattcctcattgccgccaatgcttcctcttcttctgacccatatatgacatctgctggctggaaagtctactccaggcgaggtatcggatgctccagtgggtagtaaggactgtgccatagtggcgaccagtggttgaactcctcccatgtgtattcataccccaaaccaaaagtggtaccatgtttcttcagcttgatgggtttggcaattccctggaggtttttgccaagtccctttccaggctcatatccacaccaattcagtatactttcaatcttgttatcccaccatttatcctcgtcgacgacattgactcgctcaatgtggtggtaggtttccccacctatcttcttccttcctccaatcactgggatggtctggcgactgtataagggattgctaccgtcgccatgaataatcacctcttggtgattccactaaaacttcactgcctggtgtaaggttgatgctacagctccagcagcatgaatccagggttttcccaatagcaagttgtaagatgtcgggacgtctatcacttgaaaatcaacgtcgaaccaagtcggtcccatttgcagacacaagttgatttccccaatagtggacctttgtgatccatcgaaagctttgacattgattgctccatccttgatctcatgcaggctcttccccaatgtcctgagagttaccaatggacaaatattgaggctggaccctccgtcaatcaaaactctggtgatgaaatagtcttcgcattgcacagtgatgtgcaacgctttgttgtgacttagctcttctggtggcaactcatcttcgtggaaagtgattttatgactctccaacactttccctaccatgtttgccatttctcctccagttatgttgttgggcacatatgcctcgttcaacaccttcaataaggcattcttatgtgcgtcagagctttgtagcagggctaagatagagatctgggctggcgtcttgttcagctgatcgatgactaaatactctttggcttgtatcttcctccagaggtcatcaggcccagtttcagtgacggttggtcgtccagaggcttgcttactggactcagctagatgttctggagtatagaccctgccggttctagtcataccctgtgctgcaattgtttctctagattttcctttccctttccttctcgcctcgggcgtataatcccaaggaatggccttcgtatggaatggtgatatggctgacatagctactggaatgggtacccttgctttggaaggtaatacagccacttcaaatggtaccggtgctttcggggatccaaactcgacctcgattggtcctggcacctttgtaggaggaggtgcttcgaacgcaagcggtatagacatgttcactttagcgtccccagaaggctggatctagacaacaatcagattaagtgtgactgttggtttcttcggttcgtcaccttcggcaatcaatccaatcgaccctttggggccctaatcatcttctatctcgatcatgtgaatgcctccccctttgtggtcaggcagagggttgttgcgaatattaagagtaggctccttttccacgatgatcttattgtcaatcaaggcttggatcttatcctttagcgagcgacactcgtcaatggtatgccccttcatgccggaatggtatgcacaggttttgttcgggttgatccattgggaaggattttttggagttatggcagggatgggggtgatgtaaccaacagctttgaccctttcatacagctggtcaattggttcggtgatggcggtgtattatctgagaggtctgcggttgaaatttggtcgaggtctagggaagttttggcgagtaggaggggattgatagtgagagggttgagtattctaagcttggtagaccggtgcgggttgagagtatctgggtgaagtaggctgatacgtgggaggtggaggtgattggtaagcgggtggtggagcttggtaggagggcgagggtgtttggtagtttggagtaggttgatatgtgagtaggggtaatggataggtttggtattttatttaggattttgttctctgtgcaactatcaccgcactcacatcctttttcttggacgtgccaccagactgtagagccttgttggtagcctgttatgcttcaaggttggtgaccataccagttttaataccttcctcgattctctctcctagcttgatgatgtcggaaaatttctggccctcgatcagcatcaacctctcataatattgtgggtcctgagcttggacgaaaaacctgttcgtctgttcttcttctaaggacggcctaaccttagcagcctttgatctccaacgagtagcatactcgcggaatgtctatgtaggtttgttcttcaaattctggatgtagaatacatccggcgcattctccataatgaatctgaacctgtccatgaaatcggacgccatacctacccagcttgtccacttcttaggatcttggctaatgtaccaagatagagcatctccgttcagacttctcataaagagcttcatgcagatcttttcatcccttccgactccgaccagcttgtcgcagtacgtcctcaaatggactctaggatcccctgtgccatcaaacattttgaacttcggaggtttgtacccctcaggaagttcgacatctggctgaatgcaaaggtcctcataattcagcccctcgatacctttgtttccttcaacaccctggactcggctagtgagcttcttgagttccgcggccaggttcctgataagagagtctttgtcatccgactcaggtgtacttgaaattggttgagtatggtgtggtatggtttccacacaaatgggagtgttgtggagatgatcaattgtggtgtttagcggttcagggatgagcaatttggtgttgtttgaagtgtggcatgtgttgtagtgttgagcatgagtgggttgtttttatggtttcaggatgttttgtggaggattttgagggttgggaaagttgatgtcgggagtggtaagggaaaatgacaagttttccaagttccgaacttggtccagttcttcctgaaacttcaataatttctgttcgagctgggaggcattctctttggcaacctgagcaccctgaggaacctctaccctttcaattgcgttttcctttctaatgttgttcaaatcttccatttttcccttgttcttgtttcggataggactcggaggaggaggaggtggaggacccttggatcttttggagtatgatgatgatgccagactgcacgaactaacctttgaggaggggaataaaacaaaagaaaaaaaaaaggtaacaagttagtgaggatcatgagaagaaaacgttgcaatatttaaacacatagtgcaagaatataagtcgtgtcctaatttgggagcctcgttgtgcccgaggtaggcctagagacaagttgatttggagaacttataatgctaaatgcctcattttattgataaaataactcaaattccaaaatgacactaaatagcaaaacgtaaaatgtcactaatgaccattggctttattacattaaaagcaagaagaaaatactcctaactacttggtcctagaaggaccttccccagactcggcatttttagctccatctaacagcttcaccatctcacgcagtcgtagcagtaagtaagctctggccagatgcccacccgcatttccttcagcattttgacagtcttcaattttttttaatgaacttcccttccagttccactaaaccttgctctaagtaccccagtcgcttgttggcgcggacagccatatcattccattcctcaatcagcttttgatgggcttcttgaatttcctgatgctcacttttgtattcccgaatcctcttacacagctgcttgtacttaacctgtgcttcagccttttcgtcgatgatcctgtgacctcgaacaaaaccgggttgacctaacccatcataaccgtcttctaaccaatccaggtagtatggagtatagccagcgcagtacgtgtctggttaattagaatcctttcctagggcaattttgcaatgccacatgtgttgagcttgacatttgtatgggctatcgtcatcctgaaagtcggctctgaagtggctcatcttttcgaccctcagtataatctgcttcctccgtgcctgtctcataactcagagaggaacttaagggtaagttcccctcaaaccgataagtatcaagaacagtacatccctggattgggtaatgaactcttcagtagggaaacatccattgcacttggtcctctttcagatttttgaacaactctacccaccctttggcatcttttggctgagcgaacatgttaggcatatagttcatttgcctcgactgatggaaggcgatacgatcgtcccagtctctgcgaagaatcttttgtcgatactcacccttttggaggtgttccacgagccagagttggagtaataagttacaaccctcaaagtgcttggccccccgttgacagttcttcagggctcgatacatttctgcgatgatcataggtactatgctaaagggttgtccatcaattcattccattaatgtcctagttaccatgaccagtctggtatggatcctagccttcttcataggaaacactatcatccccaagaagcaaaacataaagacaaagacccttctgtggatatgccgcaatgatgtgagggcgaattcatccgagtaagtgtggtaggacttgctatagccatacctctcatacagatgatcgaaaagaatgtaagaatccttcaaacaagtcaaatctgggttcttctttagtcccatcatcttgaggaaacccctacccttgcgattttctcggcataaggaatcccggaggctcctatggaataccggctaaacctcctatttcctctaacaaaggagtcatttcaatgttcccaaaatggaatgccgacctatcgccatcccagaatagagtagcaacctctatgattttgttgtcgggttcgattgtcagaagagaaggcaaattttccaaatatttgcggacgagagttcgatcacttgcaagaagatcctcccaccagcttagcaaccttgggtggatgttggtgaccatgccgaatctggggacctcgtgcctcattttctgcaagacaaagatgttagacccttacccccacaagactcgactattaaatatcaacaattagcatgaaatcatttagttctccaaataaatgaacagaacatggtagagtctgtttgggtttcaaggaaacccggtggactttggacaaggctatcttaaagagtcattatgtggacaacataactaactcggctaggtttgaccatgatgcatgcacaattaaacagagtaaggtttctatggggtattagactggtactcttgagcggacaactcaagagggaaaggcacggaaccgtcgacagcaccgttgatcgactggttttaccgcaaatatgcctttgccaaatttagggggtgataatattggaagggcgcaaccactcattataagcgttgctatggtatttggtttggcacgagtggaatatgatgttgaagatgtaatttaaagaatgaaacaagttgtcacatatttgcacgttcatagagcaataataattgcttataattacaacagtattgagggaaagcggtaaacgaaagcattaaagaaataaaagacacgaagagcccaagtcagtttcgtagtagaagaagagataaagacagtaagtaaaggcaataaagaggtaataaagtcacaaataacatgaaatggtaaaagcctagagaaatccctagcagagtcgccatgctgtcgcgccccctttttctatatacatatatatatatatatatatatatatatataggtcgaaatcatgcttgtgacatttgggaggacaactcgttcccttttgggaattgggttttggatttgaagagtcgccacctaatgattaagtgcattaggacactaagaagggtttgagttgaagaaaccagagtttgggtaagggctagaaattatctcgaggggaaggtgttagggacccttcaaggtccactagtgtggttcccggccatgtgataattgtgacttcatgtaatcaaatgagcaattaagactcaaataaagggacttgcacacaacattgtaaataagttgaaacttttgagaaaaataaagaaggtagaattttgtgaaaaagatttaagcaattatggagaaaacaaataagaaagcaagtaaagggagtgaagtcctaggttttttatttatatggatcacgtcaatgcaatatccagtaatcactcctcggaagaggggctacatgagatattagcacatcggtcatcatctccatatctgcccttcccaacccgttaggtattaaagtgcagaatggtatcgttgcttattgcatgctattacccgtcccaatcctatcagtctcggaggcattgagactactaatcctaaaggggtgggagttggggattttcagagttttcaaaaggataaaaatataagcaacaaacaataacaagtagcacataaaaggggaaacaaataacagttagggttcagataagtctcctcattcaaagcatcaaatcaattagcatgacttacaagtactggattggtctgaattaaattaagacgtaggataggctgattcatcacatatttctcagatgaggagtccgaattagccctgtttagatgtagttgtcaaagactgacacagttgattaattacctaacagttttcctaggtgaggcctataggcatgacatctaatagagttgtactgattttaagaaaagctactgattttagaaaaaagggatatgcaaattttaggactgattttagattccaaaacgaaactgattcaattaatttagtcctataggcatggtctctaagtgtccttgattttaacagttgcaagagtcctatatacatgatctataaatgaattgattattattcgacctaaagttgtttgcctagtggtgtatatatgcagaagtaccgaaagacttataggcatgctttccaagtgcagagatgcagaattataaaagaccctataggcaggttttctaagtgcaaagatgcagaaatataaaagcctataggcatgttttctacccctttacatgcattcattccacatccctttccactatccatcccaatagttattacaaaattattacagaccgaatgaatcagaaagaaagtaaaaattacatcagcggttacagctacatctaatcagcctaattcagactcaaagtccaacaatataatataaaccaacttccaggatcatatctccaaaagtctttctcatatttggagtgtgtgaaagttcccaagagtctcaaagggaatccgggcagtggttacaccccatacatttcaaaatcaagaacatactacaatgtggaaagaccagctctcagatgtccaagttcaaagggaactcaaggtcccaaagaaaggctcaaaagagaggggcagaacttaagattctaggaataggtgtaagtgcacaaaggggaatggaatcagggagagacagggcaagctagtggtcatgcccagcaattggaatgctggcacacccctgaccagcctgctagttaagtatttagtgttaggatccattgtggatcaagccaaggcctggacagtaattaggatactgttaggccaagagcttaactcagcacatagaaggaaataagggtagaggattttggaaaagtggggtgaggcagaatatttaggggtgatggtgttggctaaaaatggggttgatggtgttggctaatacctccggggatcagtccagccttgtgaagggagaggactctgtgggcggaagatactctgttgtcttgctttcctcattcgcatgagagacagacacattgtgcactcaagatgatgaatgccacaagagagatagaagaaagaagatctgtctcgattctatctctatctttcgacatctcatctctataatagagataataatgggtggagaatccttgtgtattctactggtatagaatctttgtggaaggcgggaaacttccgtctagcggtcatgggaaagccaaaacttgtatataataagtcaatactgggtcggtcgagactctttcttagtgaagtgggaagacatcaccgaatcagacgggcacagaagaagaagtggttcatccgaccggcgagataattcgatttctagtcagctaactgagaatccaatagagaaaattgcttttctaatgatttctcgatagaacgatttcttgtgagccacgaaacagataatccaagtcgtaagtacgaaccactcaatggagaatctcaggccaataagctacgactacgaaacgaattggatcgggttcagtgcttgaaagctatcgaagaagagtcaattcaatgctcaagtcaaaggggggagtcccttctgtggatatgccgcaatgatgtgagggagaattcatccgagtaagtgtggtaggacttgctatagccatacctctcatacagatgatcgaaaagaatgtaagaatccttcaaacaagtcaaatctgggttcttctttagtcccatcatcttgaggaaacccctacccttgcaattttctcggcataaggaatcccggaggctcctatggaataccgaataaacctcctatttcctctaacaaaggagtcatttcaatgttcccaaaatggaataccgacctatcgccatcccagaatagagtagcaacctctatgattttgttgtcgggttcgattgtcagaagagaaggcaaatttcccaaatatttgcggacgagagttcgatcacttgcaagaagatcctcccaccagcttagcaaccttgggtggatgttggtgaccatgccgaatctggggacctcgtgcctcattttctgcaagacaaagatgttagacccttacccccacaagactcgactattaaatatcaacaattagcatgaaagcatttagttctccaaataaatgaacagaacatggtagcgtccgtttgggtttcaaggaaacccggtggactttggataaggctatcttaaagagtcattatgtggacaacataactaactcggctaggtttgaccatgatgcatgcacaattaaacagagtaaggtttctatggggtattagactggtactcttgagcggacaactcaagagggaaaggcacggaaccgtcgatagcaccgttgatcgactggttttaccgcaaatatgcctttgccaaatttagggggtgataatattggaagggcgcaaccactcattataagcgttgctatggtatttggtttggcacaagtggaatatgatgttgaagatgcaatttaaagaatgaaacaagttgtcacatatttgcacgttcatagagcaataataattgctcataattacaacagtattgaaggaaagcggtaaaagaaagcattaaagaaataaaagacacgaagagcccaagtcagtttcgtagtagaagaagagataaagatagtaagtaaaggcaataaagaggtaataaagtcacaaataacatgaaatggtaaaagcctagagaaatccctagcagagtcgccatgttgtcgcgcccgctttttctatatatatatatatatataggtcgaaatcgtgcttgtgacatttgggaggacaactcgttcccttttgggaattgggttttggatttgaagagtcgccacctaatgattaagtgcattaggacactaagaagggtttgagttgaagaaaccagagtttgggtaagggctagaaattatctcgaggggaaggtgttaggcacccctcaagatccactagtgtggttcccgaccatgtgataattgtgacttcatgtaatcaaataagcaattaagactcaaataaagcgacttgcacacaacattgtaaataagttgaaacttttgagaaaaataaagaaggcagaattttgtgaaaaagatttaagcaattatggagaaaacaaataagaaagcaagtaaagggagtgaagtcctgtgttttttatttatatggatcacgtcaatgcaatatccagtaatcactcctcggaagaggggctacatgagatattagcacatcggtcatcatctccatatctacccttcccaacccattaggtattaaagtgcagaatggtatcgttgcttattgcatgctattaaccgtcccaatcctatcagtctcggaggcattgagactactaatcctaaaggggtgggagttggggattttcagagttttgaaaaggataaaaatctaagcgacaaacaataacaagtagcacataaaaagggaaataaataacagttagggttcagataagtctcctcattcaaagcatcaaatcaattagcatgacttacaagtactggattggtctgaattaaattaaggcgtaggataggctgattcatcacatatttctcagatgaggagtccgaattagccctgtttagatgtagttgtcaaagactgacacagctgattaattacctaacagttttcctaggtgaggcttataggcatgacatctaatagagctgtactgattttaagaaaagctactgattttagaaaaaagggatatgcagattttaggactgattttagattccaaaacgaaactaattcaattaatttagtcctataagcatggtctctaagtgtccttgattttaacagttgcaagagtcctatatacatgatctataaatgaattgattattattcgacctaaagttgtttgcctagtggtgtatatgtgcagaagtaccgaaagacttataggcatgctttccaagtgcagagatacagaattataaaagaccctataggcaggttttctaagtgcaaagatgcagaattataaaagaccctataggcatgttttctacccctttacatgcattcattccacatccctttccactatccatcccaatagttattacaaaattattacagatcgaatgaatcagaaagaaagtaaaaattacatcagcggttacagctacatctaatcagcctaattcagactcaaagtccaacaatataatataaaccaacttccaggatcatatctccaaaagtctttctcatatttggagtgtgtgaaagttcccaagagtctcaaagggactccaggcagtggttacaccccatacatttcagaatcaagaacatactacaatgtggaaagaccagctctcagatgtccaagttcaaagggaactcaaggtcccaaagaaaggctcaaaagagaggggcagaacttaagattctaggaataggtgtaagtgcacaaaggggaatggaattagggagagacagggcaagctagtggtcatgcccagcaattggaatgctggcacacccctgaccagcctgctagtcaagtatttagtgttaggatccattgtggatcaagccaaggcctggacagtaattaggatactgttaggccaagagcttaactcagcacatagaaggaaataagggtagaggattttggaaaagtggggtgaggcagaatatttaaacaaaggacataccagtttcaaagaaaataagtaagcaaaagtagccttgaaagagccaaattgcaagcagcagttctaaaagatctcaagcaaagcaggaatagaaaacagtattgccagaaaagtgagttcagtgtgtgagtggtgtattttcgtgtatttctaattgctgagaattgactaatgatagaaagagggaggactaggtccttatatagtttttgaaaacaagtaaggcaggcaaagagtgcacaaacatagaaaccaatcaattagtatcaattaagacaactaaactcttttaattaatatgtctaggtcaaacggctaataaagatagcttaaggaagaaaaaatcagtttactaaggctgattagggtaaggaaaccatatagtgcagaaataaggtcaaatacatagttggtaattaaggaaaagtggaatagtagtgtgaaaataaggtatcagtttgaaaagtaatcaaaagaatcccggatcccattgtaatcacaaagaacctaaagtaattaaggaaagaaataattcagacgttggtacagaatcacagaggatacacaagaccatgtatttaaggaaaacatcacaagcctgggttaaatcttttgaaagggaagtttttcctcatatataaagcatacagttcaaacaaaagaaaagcttaacaatgaaaatttcagaatcacatgcaagtaggattccgaattcagttccaggctcacagtgagtctggaaacctagggatccaaagtgaaaccctaatgccatccacctaaagaaaaaccccctaaattttagggtttcaaatagaatcaggggtgagaaatcattcaaagtcattgagagaggcagacatacacaaacaaaagcaagaaaaactacgagttttaagacaaaaggtaggcaagaacatgctgagcaggaatatcaacgaaacttagtaaagtgaaacaaaatcaaagcacgaacttaaacatacataacaaagagtgaggagcaatgacctaagttagcatgtgaacaaataacagaaaagaatcttgcaaaatcaggaaagaaataagagaacaatcttaaacataataagaaataaacaagcgagcataaacacacataggagagagcaaaagagtcagaaaacatgtagaagcttttccagaaagcctaaaatcggatttgaacaattttgaaaaggaaatttggggaaaaggccttaaaacgtctattaaagaccaaacacgtcacagatctgaaagaaatagacgagtaaagaaccttaaaaggtttaaaaacggcagagaagaccctaggatgagaaggtcttgaggaaagtcggatcccgagtcggtgaaactcatattgctatgaacatgccggaaaatggtcggagaggccatggatcttgcagatctaagacagatctaaaggagaccatggaagtcaggcctccaatctttgaatagcttaagttagtggttagggagagtgagcacaggccacccatggccaggattgccatggattccggtgggaatgagacggagatcggtggaatagggttagggtttcggagggctagagaggttttgggagacgaaggaggtttagaggcggcgtctttgtgcaaatgagttaggtttagaggggttaggggattaaaaaaggaaagggcaaatcagggtcgttgatcaaaatgatcaacgaccaggattaaaaggaaatccggacgggtctgaaaacgggttaaggggttgggttaaaaaataaaattggatcgtttcattgggtggaattggggtttaatcttgggctaaaactgaaatgataatgggctgtgtgttaaatagccaatttctccctttttagtttttataaaacagttaaaatgattttaaaaacaaattaaaagcactgaactaattaataatatataaacattaatctaaaaatactaggaataatttcataattgtaaaacgctattaatcgtaatgtaggctataattgcaatgttatactatttagcttaaaaaaatatcaaataaatttataaaaatatgcaaaaattaccttaattatattttggtgtaaatatgaggatggaaataaattattcaccaaaataataatttttgaaataattattggattttgtattgttaaaatagacaataaattgattttaaaaatcttaaaaattggaaaaaaaataccaaaactcttgggcatgcttatatatgcatacacatgctattttgaaggtattgtgagtataaaaatacataagggaaaaattgggtatcaacaacagatgcggacacctggtcacaaaagcgaaggaatccttggctggggatcaccgcagaagtgaaattttcgtaacgcactatgtgcgtgtaaatgcgagatttgagcgcagaagcgggctttgccacagatgcgggtccttttgtcgcacctgcgatgtcataggagcggatgattttcgtaggtgcgaggtccatttctccaatgcttcaccaaggaagctgagtgtttgtcgcagaagcgacgccgcagaagtggccctttgttcgcaaaagcgaaaatcgcgcgctggccagaacctatattaaaatcgagggttttggttctttcttcatattttgagatgtgagactcggattaaggcgacttttgaggcaattttcatcacaagaattggggtaagtattctacactcgattttgattatatttcatgaatctatattcattttgggcaattggttgatgaattttaaagagaaattgggggttttagcctaaagtttcataacgtgaattttgtagttttgaacttcgagttggagtcggattttagtgaaactagtatggttggactcgtaattgaatggaatattggattttgtgagtttcaccgggttccgaggtacaagtccaggttggacttttgggaaattttgggctttagattaagaattcgacctttatcgatttggtttgtttcccttggcattatttgatgtatttaagttgcttttggctagttttgagccgtttggaggtcaatacgcatgggatagcattcttggagcatcgcttggctttctcggtattggaatttgcttatttgaggtaagtaacacttctaaacttgatgttgagggtatgaaaccctgaattacgtgttatgtgtttggtgtcgaggtgacgcatatactaagtgatgggcgtgtgggcgtgcaccatgtaagttgtgactttcttattttcgtgtactttgtagttacctgatcttagttgtaaccatgaaatctctatgtactaaagtaattgagctgtcaatcatgctagagataatgtttaggctatatgttggtaccgttgagactcatagtggtcgtttcttactattgatttattgatttcattggaatttcgcactcagtgatattcattcattacatatcataactcagtatctgttgttatttattgatatatcatatcatcattttcgggctagtttcatgacattgtgatcccgtgagagagagattggagagattgatgattgagtgctaccgagagcctgattacgaggatattgatattatagcacgagagttgtccgtgcagtacgtgagttgtccatgcagcacatgagttttccgtgcgggtcctgatattgatactatagcacgtgagttgtccgtgcggattatagcgcttgggctaaaggaacccctctagaatctacacacacccctagtgagtgcggttgatttatactgagggatggttcttccatggacatggattttgtccgaagcatttatacttggggatggatcttcctgtgacgaccagactagtcgtttcatgagttaccgctctatttctcccattttttgcttctttatgcttcgttatccatgtgttatgtgattgagttgattagtttgtgtccggaggggatttggtaagaaatgagatacttagtctcttttaagaaggtttagtttggaaaagtcaaccggatgttgacttatgtcttagagggatcggatgtgagtttcgatggctcggttagattggggaggtgatttgtgacttaggagtgtgatcggaatttgttttggaggtccggagtagaattaggcttgaattggcaaagttgagattttggcgattttcggttgataggtgagattttgatataggggtcggaatagaatttcgagagttgcagtagcttcgttgtgtcatttgggatgtgtgtgcaaaatgtcaggtcattcggacgtagtttggttgggttttttatcaaaagaatgtttcggacacaaacttaggctcgaaaacttaggcttgaattcgatgtgaattggtggatttggtgttgtttgaggtgttttgatgattggaacaagtttgaataagtttttaggatgtgttcgtgcttttggttgaggtcccggctgttgatacccaatttttttcctatgtatttttatactcaaaatactttcaaaatagcatgtgtatgcatacataagcatgcccaaaggtttgggtatttctcttttttttttaaagatgttttaaaatcaatttattgtctattttaacagtacaaaatccaaaattattcccagaattatcattttttggtgaataacttatttcatccttatatttacaccaaaatataattaaggtgatttttgcatttttttttataaatttatttgatagtttaaagctaaatcgtacaaaattgcaactatagcctattttataattaactgcgttttataattataaaatcatgcctggcatttttagattaatatttgcatattgttaattagttttgtgctttcaatttgtttttagattatttttagctattttaattaatttaaaagggaaaaaatggctatttaaaagctggcccatttccatttcaattttagccacatttgatgccaatttttaaccccaattcatccccaatcagacgacccaatatcccattcaacccgccccaaacccaattgcctaacccgcccgcctcccatctttaaatcttggccgttgattgttttaatcaacggccaccgtcctttcttaccatttttaattccccaaaccccctaaccctaaatcatttctaaaaaccagcggccaccaaatcccttcttctctcaaacgctctctaagtcactcggaaccctagccacctatcgtcgtcttcgaccaaatccaccggcgtccatggcttcccaggccatggacggcctatatcctcttcctttcaccccaagccatgattattcgagccttcaaggttcaaccttcaacagacctattcaggtcctccgccgacctgagttcctttggcttctccggctccgttccggtgtgttcgaactctgaaaagcgtagccatggcccagatttgttccaaaaccagatctttccgagccttttcatttctagggtttctgagaaaccctaaaaagcttgttcgaggtttttcttcccttgtcttcttagatctgtaacagatctgtgttctactcgatgtcttcatgcttttcccaattttcccttttaaaattagtctgttcaaaattagggttttcaaaagtcctgaaacggcttttcttcttcttctttctttatgtgaatctgtgtgttcatgccatgacttatttgttttcgtctgttcttatgcatgttttactccgttattgcttctactggtttttacaagtatgatctacacgtttatcttgcatgactttctactgtttctcctattaagattatttgcctctactagattcgtttggtttctaaacttgcctcttttactgcttcctaaatttctatggcatctcttctctcttctgacttcacttgagttctgagctttctcttaatcttgtcctttacaattttgtcactctactgcttctaatttgctacgtgtgtttgtgtatttcctcagggaactctttcagagttccctaggcttattgtgaggtcttgccttctcttttctgtgtcctactcagattgaaaccctatttggggatttttgcgagctttggttctagggttctattccagaaaccctagactctcaaatttgtgctgagttcatggactgaactggaacctattctttacttgtgattttagaactgtttatgccaatctcttcttccttgcttgataccggcatgcttatatacgaggttttgttctttttgaattgatactgttaacttgtgattgatttcaatccccttcactaaggctcgattgatttgctactgatttttacaacttagccttttccctattttcctgactaagttcattcaagacttttaaagatttccggctgtttgattattttatttccttattctttcaaaaccgtgtactataatttcttaccttaaatagactctgtatgaacctaccatttattatgctactctgaaaggttttcctttccttaattaccactcctgtttgaaatcaaatccccctaactaagggagattttatttgattgactggaattttattttcttgcctctttgtttactcgtttttgcactataaaagctcacagctctcacaagttttaaaaaagtttttacacaatcactcgaacataacacaattctcagaatcctttctgcacccttgcaatacactattactctctactctctactctactactactctctactctctctactactattgagcactctgctcccttctctcttactgtctgaacatctagagttcctctgaactcccaagtgcttgctgaagttctttttttgggtttgttcctgttgactgcctggatgtttacttgttgttgttattctgctgttctaaaacttgcaactggtatgttctcctaattaaataacaccctcttactatgtgtttacttctcctcttctacacttctttccctatgtgtttatttatgcttccctgcactatgtaactacattcaagcatgttatgccctttctttacgtttccagtctgttatgcttcttgtgtatacttttaatcccttccccctattccctttgtatgtgagtattgtcctggaccatggcagcaccttgaattgatgtctgtgatctagaactagactttcttgagtctttactcaattgctttccccttccctctcccttttatgtgctgagctttaacttgggtctggtggtgtcctaatcaccattcagacctaagtctgactctctgagagtctgctcttatttgtttgaacctaagcaaggggtcaggggtgtgccagtctatgccatggctgggtatgaccacctcctgctggggttcctctcacactttgctcttactcctagttcttaagttctgcccccctttggtaagccatgctttgggaccctggagctccctctgaacttggatgcctgagggctggtatttccacactgcactattctgttactataatggttatccagagtgtaagcactgcctggggttcttgaggctccttggaactttgaaacactctgagtaagagaaggcttgaaatctggaatccggatttggtaaaacacatgtattggacattatggttgcattgagcttcctcggatctagctgtaggtttgatgtatttatttttatcccctctctttctggttctgtaataatcttgtaaaaagaactcgggaaaattttagtaaagggtgtggtaggggtttatattgtttacgttattgctaaagggtagaaatcatgcctataggtttaatcttgttacttaatcacttagataccatgcctatagtttcaacgctttatcacttagaaatcatgtctataggctttgcatcttttcactcaagcatttagaaatcatgtctatagggtttaatgttcagcaaatcagtagatatcctgcctataggatctaataatcaaaaaataacctgttgcatatagaaatcatgtctataggaaatgcataaacgctaggcaaactatagggtaatcaaatactcgtctttcttaacgtttaaaagtggaaatgagtcaataaaatcaaatatggatatcctgcctataggatttcaaactcgcctaaatctgtgtaaataataatctggtaattggctttagcgttttcaacaagactcgtccaaacttgtctgcaattttctaaacttgcatttctgtgtctgaaactgtttccaactctctgcctgaacttttactcataaagctctctttcaaaaacagttttcaaactccttcttttacaacattcttacttctgaaaactctactctacaattccactgtactttttacttaaacaattctgccgatttttgaatcctttctgaacttctataatttccaatcttctgttttaaaattcttctgcattaggttcctaatcagtaactggttttaaaaaatacaacaacttctgacaattggatccgggttgcctaatgcagactttttatccaactctatgtgttaaaccagtcggtccgccgtttaactttaatttaaagaccaaatcagtatatgcaagacatgctaaactaattgctatgtgatttgcgggattttatgtgagcctttgtatgtttgtttacttcccactatttgctatctgttttgattgacgccctagtattttatcctttcgaaactccatatatgcctctaccccttttctccccctttaggattagaagtcctaatacctcgggactgataggttgggacgggtattagcatgcaataagtaaactaatcgcgtttaataccttaacggggtgggaagggtataatatggagatgatgacggtgcgctaatatcataggcgacccctcttctgaggagtatgtgcggggtattgcaccgagtgatccatattatatttaaacctaggacccttttctctttctttatttatatgatgttttcttaaagattaatgttttctttaactaatctttcttttcaaaatctttctctttctctttcaaaattttcaacttatttatatcccctatgtgtgagccttgtttgtttacttctactcttcttaaagtcacaactaagtacggccggaaaccacactagtggatcttgatgggtgcctaacaccttcccctcgagataatctcaagcccttacccgaactctggtttctctttcaaaatcttcttttcattaaagtgtcctaatgcactataatcattaggtggcaactcttcaaactccataacccgattcctcaaaagggaataagagttgttttgtccataatgtcgtaaacccgatttcgcttctttaaagggaaaaagggggcatcgacaccggctgcctcgggtgagtttcggatggtcaagcggaccatttttgaagtttaagaattgcagattttgtgttcagcagttgtagaaaaattgggccttcgcgatcgcctggggtatatcgcgatcgcatagaaggaatttaggatggccagagttaagccttcgcgttcgcgtcataggtctcgcgttcgcggaaggctggaatcgtgtgcttcacattcacatgaggtattccgcgatcgcgtataaggaatggggtcccggtggaatttggtcttcgcgttcgcatcagagggctcgcgttcgcgtaggtattggaagttgaagcatcgcgttcgcagggtattggtcgcgttcacatagtgttttgtggaggtcttgaagattttctcttcgcgatcgcgaggcttgtgccgcgatcgcgatgaagaaagaacagaactgggcagaatgcttttaagttatttcatccgcgattttaggtcatttttcctccatagttgatcattttgagagcttattgagggagattaaagagggattcaaggagaatagattggaggtaagatttttgaacctaaaacgtgattctattgtgaaatcaacctagcaaaatcatggaacttaagctaaaaatagaagaactagggctttggattttgaacttttgaattgggatttgaaggaccatttgaggtcggatttgagaaattttgatatgtatgaactcgtgggaggataaggaacccgttgatgtgaaaatttctgagtttcgagaagtgggcccgggactcgagttttgcttatttcgggatttttgatatttttcgattgttttcgattgggctttgttcccttagcatattgtgacgtattcgttttgattttggatagattctacgcgcgtggaggccgattcgaggggcaaaggcatcgcgagttagaggtttagccggttcgaggtgagtaatgcttgtaaatgatgtcctaagggtttgaaaccccggattgcacatcgtagtgctatattgaggtgagacacgcacttgatgatgagcgtggggtcgtttactattggggattgtgactttgtccgtcccgattgatgattttaccgcgtatttgactgaaacttatttgttatcatcatgattcgggtcgattgccatatttgggctgattgccaactatttgaacccttcgggatttttatcagtatttccttactactttgacttattacttgagttcagtcctgttgttttccactgttttacaactcagccactttaactcagttttgagacttaaatgatattcctaaatgatgttttaggctgagaactactattttactaattcccgaggggcttgtgatgatttttggactgagtgcggctagggccagatgtgaggatacactgagtgatatgaggtcgagggcttgagatacatatatacgccacgaggtggcttgagtgatgtgaggccaaaagccgagagttgatgccacgaggaggcttgatatagcgcttgggccgtaaggggcccctccggagtctgcacacccccagtgagcgggggtacccattgtgatctgagagtgagcccgaggggctgatattgttttgagagtgatctcgagaggctgatactgttctgagtgattgatattgtgcccgaggggcggatttctacttgttaaaaaggggttctacgtgatttcttcactgatttactattttaagtgattttactactttggtataaaatgctttgtgcttttacgtgttttcttgctttcagccattatttataattattactcactgggtcggaggactcacattactccctgcaccgtgtgtgcagattcaggcatagcagattcctctcatgagtgccgatcatcccagtccaggcggtgtttcggagagtacaaggtagttgttggcgtccgcagcccccgtgcctcccttatcttattatttctatgttcttcaaacaattgtacccgatttcgtatttagtagacttgaatcaggatcattagttgctcatgacttgttaccccggttagggctgtgtcgggatggtttttccactattgttatctctacttccgcgaattattgctattatatcatgttttaaactttcttatggtaatttactacttaaagaggtgttctgtgttggtctggctggccttgtcttcacgagaggcgccatcatgaccgggttaggggttagggtcatgacacttccccatgggctagattggccctactcagtactaagtgactgatggtcagttgatgtatatattctgggatggatcttccctgggccgggttggccatatccagtactgagtgattgagcatgatgagtgaaaagtgtgagatagtaagattaggtactctgagagtgtgactatatgagttcatatatgagatacattgcattgatatgcacacataacacacaagcacagagatgtattttcctcatgttgcacggtatcacgtcatttatgacttctcacacatgttgacatatgggcatagaaatgtattttacacttactatctggaaagaaaatgaaacttcttatttattattgaaaggatttttgggaaaagaatttcagttttcaaagttactcatatttttggcaactccggtaaacgacttgggttttcactgatatacttgaaaggcagaactatttttaaggaatcatgattaagctacgcattttatctctaagttacttcttctattacttttatgttattatggactgttattggcttttggtgttggacccgacctttgttcccagctcgtcactactttcaacctaaggttaggcttgttacttattgagtacatgggatcggttgtactcatactacacttctgcaccttgcgtgcagatgttggctgttgatgttgctgtgatcgacgggatccagaattgaagacgtacctgcgttccggttgtatttgcctctcgttcatggtagccttagcttcataaagctctgtttatgtacttttcgaacagatgatgtatttatttcataccaactttgtaaattctattcatagaagctcatgatttgtactactagttcttgggaaatgtataagattcaggcattttcttttaattaattgtcttatcaaattttattggaattagatatttgttaatgggcttacctggtgggttgagtttggtgccatcacgactaattgaattttgagtttattatatataataatattttttttaaagtggcagccttcaactgttgaggccaaagcaattgctttagtggcttttccctggagccgccctaagcacaagttacattgatcagttggtttaaatgaaacattaaactcttatatgatagagttggaatttcgagagtaaaattttgatcgccaattcaaacctaattcattatgttttgaaataaaatttacatattcggaaggtatataaaaagtatataagttacaataattaacaattgaaaatatcacaaaattatatgaaaaaatagaacaaattaattagcatatcataaaatattgcaaatattaaccaactagctatttgtaacaaaaaaaaaatcaattctttgcttttttttgagtaggtattgttagaatagattggatacatcttaagagtttaaatatctgttttaggatgatttggtagagttttgaggtggttttaattgaaaattggaagtagaagatgaacatgggaaaaaaaaggtatgtgtgtcacatatgtatcatatttgtatcaaatatatattacatgtatatctatgtttatttatatgtgtgtgagatatacgtatgatacatatttgatacatctgtcgtagacactactagaaaactagtaaaatccgtctacagaataacgatcaaaatcggtcggaaaaaagcgaccgaaatcgatcgatatatttatttttgttgtcagtcaaagcgttaaattaaccgacagacttcggtcgtaaaattgcaaccgcccgatcgcaaccccttggtgaccattattttttcgagtaaattaaaagcggaaaaaatcggtcacttttcctcaaattccgactaatattcatgctttaattctttatcgttaaaattcagattctgtaccacgcatgtggccaggaggggcagttgcgtaaataacccatataagaagggctattaattagtcaaagttaaacacgaggtgggagaggtcaggtaggtataaatgggcgccaaaccccctacaacataaaatcgtctgcttcctttgatctctcttcaaaatttataataccgtactgaatatcagttacttcaaaatgattgtaagtgctactactggtacatttttccccgtcgaaaatcattcacctgaatttagggaaagcgcattaagaaagctaggaggaagtcttctttttgtagcaaattctaagaagtcttctttttgtagcctacaagttaaggctaattctcaagcaccgccgcatgtgaatggatcaaacgtttgccttaagcgcgatcacaggctcaatgtcgacccttttggaccgggaaaactcatggaagatggcttcgtttttcgtcaaagtttcagcatcaggtcatatgaaatcggggctgatagggtcgcgtctatagaaacgatgatgaatcttttgcaggttggcatagctgcaaaagagagacactacaagaaatccggaaaaaaacgaccaaagttggtcgcttacatatcaaaaagcgaccaaaaagcgtccaaacttgcttggtcgctattttgctggtccctttaccttaaagaccaaagttggccgctaactgtcttaaagctatgttgcacttgtatcatattattatagtaatgtttcatgagcttgagttggttgtactgcaggaaacatctctaaaccatatgaagagcataggacttatggggactggatttgggtcaactccagaaatgtccaaaagaaatttgatttgggttgtcatgaagatgcacgtttcgattgatcgctatcctacttggtaagtttctgctcttgattttatggttttagtccccccagtggagctaaagtaaagttcactcttaagcctcacgggtgtgatgtaccctaccctaatgcaagtattagtggatgttttcacagctcgaacccttaataatcaccatatggttgaatatggtgattatttgtcttatactagctgattcttcttataccaagatctgttgtgtcaaccagaggcgaagccagaattttgagtatatgagttctggaatctagaacatgataagtttctgagttcaggatagattgtttatacatattaagtagatttcttaacacaaataaaggatttgagctgcagctactggcttctatcgaacctgtggctagacttctggctccaccactgcttggcacactaattacacattttccttagccattttgaagaaattaatcatgtggacctgtgatcttgcttcgatttcttttgctcaggggcgacgctgttcaaatagacacttggatagctgcttcagggaagaatggtacgcggcgtgattggcttgtccgtgatggtaatacaggggatatattgatgagagcttccaggtttgaagaagccttcacttttagttcagctattttcaggggcagaggtagagtgtcgagagtgggttcagtcaaacttagtagctttgattcgaactatgtatttattttaaaaatccattaaatatatgtaaattattaaattaagaattcagtaatttaaaacgattagaatcccgaatccataagcttgaaatctcggctccgcgtctcgctattttaccgcaaatgctacaactctgttattgtctctagtatgtttatatatggttatttaatttgcagcttatgggtaatgatgaataaagaaacaaggaaattatcaaaaataccagatcaggttaaaactgaaattgaagttaattttgtggatttgcctccggttcttgatggggacagcagaaagttactaaaacttgacgagatcacagcagactatactcgtactggtttaactgtaagtaaaaatatctccataaatgatatagtgtctttgtaatgaagttatttaataactgctggtttattaaatttatagccaaaatggagtgatctagacgtgaaccaacatgttaataatgtcaagtacattggctggattcttgaggtacatctctttttttcttatttttcccttcagcacattcggtttaataatgtcaaagagttattgtcacgacgcggagtctcaacctcgagattatgatggcgcctaacatctacttgctaggcaagccgacgtaaacagaaaattaactaaatttaaaaattttatgacaagataataacgaagaaaatggtacaagtctgaagcatagtatgataatactgaataacgagcttaaacatgcccagaaactggtatcacgagtacataaatatctacattgctacaaacatggtctgaataaaatacactattttgaaactcagaaaaaatagtaaagataggagggaaggtgatttcaagcctgcgaacactgtgcatctgtaccttgagtcttcgtcaacaactggatccgagcaaattaatctattgaacgttgctaggacccactccaaaatctgcacaagaagtgcagagtgtagtatgagtacaacagatcccatatattctgtaagtgccgagcctaacttcgacaaaatagtgacaaggctaaggcgtgtctcatacaataacctgtacgcagaataataataacaataacaaggaaggaaaacaagaaataaaagtaagacaattaatttatgaaaacgaactcaatcatcacagtcggagaacccagaataaccgatctaataattttatgtaaaatgctggaaaaccaacaccataagaacaatgaaaacaacctacacatccgatccgttgcggcgcacaactcgatcccaccgtacacactcaatccgcccttatttcaccataacaccatttatcaatatcaagaatcatatataaaatcggttgtgacgcttaactcgatcccaccatatcatcataatcaatgtcataatcatcccttatttcatcatgtctcaaccgttgcagcgtgcaactcgatccacaaataatttcaatacctgtaatcaatccaatagctcaattcatgagaatctctacgattaaggaatatgaaagcaaagaaataaaaaaacatatactaatcaaaggaatgctacaaataatacactagcaacaagacaagtcaagtacgtgacaattaaggagtgcaagtaagacaattaattcaagtagcaataatcacggagtcatggaagggaccaacatttcaatacaagaataattattaacaagtaacaaattacggcatgggaaagcaattaaagcatgtaatagttaaggcatggagtgaagtgattcatcaaaaacgagaaagatatagaaacaattaatttgacgacgcatatacactcgtcacctcgcatatacgacgtttcacccctgagcccgattatgtgattagtttcgaaatccgacctcaatttgaggtataaatctcaattttataaaaattcccaattctaccgaaattcctaatttctaccatgaaagatcatagattaaaggttagaaatcaataagtgttggtggaaatggacgaaaacaagttaaaatatgctaacttatgaagtggggatgaaatttgtcttaaaaatctcctttaggtcgagctcaatcatggaaatggtgaaaaaacgggtaaatctcaacttttggaagttttaagactgggcttcaggtgttcttcgcgttcgcgagacacctgacacgatcgagaagcagcagcggccaaaggccttctcgtttgcgagccactcttcgcgttcgcgaaggcttactcccacatgccttcacgttcgttgtccttatgtcacgttcgccaagagtaacgactaagctcccttcctaggctctataaccctacgcgttcgcgagaggccggtcgcattcgcgaagggtaaaccctcactccgtcgcattcgagaccatgccatcgcgttcatgatgaaaaagttttgcccctatcctagtttccccttctcgatcgtgagagtaacttcgcgatcgcaaagcacaaaatgacatacaccagcagaagcaaaaccagtaggtgtctaagtcaaaaaaatcaatctgtagcctatccgaaactcacccgagcccctcaggctccgaaccgaacgtacacaaaagtgtaatgacatcatacgaactcgctcgtatgatcaaaatgccaaaaaaagacctagaactacgaatctgacatcaaaatgtatgaaattttcatataagcttaagaactttcaattttacaaccagacgtatgaatcacgtcaaaccaactccattttgctcataagtcataaatagttaaatgaacctataccaagttccggaatcaaaatccgaccggtagcaacaaagtcaaccaacggtcaatcttagaaattctttaagccttcaaattataagttttcaacaaatcatgttaaatcaagttagggacttctgaattcgattttgggcataagtcccgagtctcaattcacgagacggacccatcggaaccatcagaacactgatccgtgtctgtttacacaaacgtattgaccatagtcaactcaaatcaatttaaggttaaatttcatatttttaaaaattttcacataaaactttttcgaaaaaaatacaaactacgcacgcaaatcgagaaagtctaacggagctattcaaggtctcggaacacagtaatgaaggataaaactcaaaatgaccaatcgggtcatcacattttccacctctaaaacaaacattcgtcctcaaaaggacatagaaaggtacttggactggtgaaaaggtgtgggtatctactccgcatgccaggctcggactcccacatggctgccttaattagttgacctctccattgcactgtaacagaaggataacttttaaacctcaacttccagacctgccatactataatgaccaccgactcctcctcataagtcaaatccttatcaaattggactgagctgaaatctaacacatgggacggatcaccgtgatacttacggagcatggatacatggaacaccgcatggactgctgataaactaggtggaaatgcgatcatgtatgccacctcacccactctctcaagaatctcaaaagtccgatgtacctagggctcaacttgcccttctttccgaacctcatcacacccttcatgggtgaaacttggagcagaaccctctctccaaccatgaatgaaccatcacgaactcgctgatcggcataactcttctgaaaaaaattggtacccaacaaccgagcctcccagctcgaaccaaccaactggcgaacgacaccacctcctatataatgcctcatagggagcaatctaaatactcgactagtagctgttgttgtacgcaaactctgcaagtagcaagaattgatcccaagaacccccaaaatccataatgcaagtgcgaagcatagcctccaatatctgaatggtgcgatcaagctatccggctgtctgagggtggaatgttgtactcaactcaacccccatgccaaactcatgatgtacggccctccagaagtgcgatgtgaactgcgtacctcgatcaaaaatgatggaaacgggcacaccgtgaagatggacaatctcgcagatatagatcccagccaaccgctctgaagaataggtaactaccacgggaattaaatgggccgacttggtcaacctgtccacaatgacccatactgcttcgaacttcttctaggtccgtgggagcccgaacaacgaaatccatggaaatacgctgccacatccactcagaaatctcaagcttctgaagcaaaccaccaggcctctgatgctcgtactttacttgctaaaaattcagacaccgagctacatttgcaactatatccttcttcattcttctccaccaacaatgctaccgcaagtcctgatacattttggcggcaccctgatatatggaataccgtgaaatgtgggcctcctcaaaaatgaactcacaaagcccatccacattagttacgcaaatacaaccctgcatccgcaacaccccatcatctccaatagtaacatgcttggcaccatcgtgatttaccgtatccttaaggacaagcaaacgggggtcgtcataccaaaactctctgatgtgctcatacaaagaagaccgaaagactatgcaagctagaacacgattgggctgtgaaacatctaaacttacaaactgattggacaaagcttaaacatttgatgctagcggcctctccccaacctaaatatacgcaagctacccatactcacaaccttcctactcaaggcatcggccaccaccttggcgttccctggatgttacaaaatggtgatatcatagtctttcaacagctccaaccacctcctctatctcaagttgagatacttttgcttgaacaaataatgtatactccgatgatccgtgaacacctcacacgatatgccgtaaaggtaatgcctcaaaatcttcagtgcatgaacaatggctaccaactctaagtcatgaatagagtaattcttctcatgaaccttcaggtgccgtgacgcatatgcaatcactcttccatcctgcatcaatattgcaccgagcctaatacgagatgcatcacaatacaccatgtaggatcctgaacctatgcacaataccaacactggcatcatagtcaaagcagtcttgagctgctgaaagctcaactcaaattcattagaccacctgaacggaggacccttctaggtcaatctatttaatagggctgctatggatgaaaacccctccacgaaccggcgataataacccgccaaatccaagaaactctaaatctctatagctaaagtgggtctaagccagttctgaactgcctcaatcttcttaggatccactcttaggccctcggctggtaaaacatgccccaaaaaagcaaccgagtctaaacaaaactcacacttagaaaaattggcatataactgactatctctcagagtctgaggtacaatccaaaggtgatgctcatgcttttcttgactgtgggagtagatcaagatatgatcaatgaatacgatcacaaaagaatccaactagggcttgaatacccgattcatcaaatccataaatgctgatggggcatttgtcaacccaaatgatatcactaggaactcataatgcctataccgagtccgaaaagttatcttatggacatccgatgccctaatcttcaaatggtggtatccagacctcaaatcaatcttcgaaaacaccttggaaccctaaaaatgatcaaataagtcatccatccagcggcgggtacttgttcttgatagtgaccttgttcagttgttgatagtctatacacatcctcatcgaaccatcattcttcttcacaaacaacacgggtgcaccccaaggtgagacactaggtctaataaatcccttatcaagcaaatactgcaagtgctccttcaattccttaaacttcagtggggccatgcggtatggtggaatagaaatggactgagttcccagaacgagctcaatacaaaagtcaatatctttgtctggtggcgtccccgacaaatctacaagaaacacctttagaaactcacgcacgacctgtaccaaatccgtggaaggaacctccgcattagaatcgccaatataagacaaagaagctaaacatcccttctcgaccatacgtcaagccttgacataagaaacaaccctgctggtagaatggccaggagtccctctttactctaatcgaggaaacccttgcatggctaatgtcaccttcttggcgtgatagtccaatatagcatggtaaggtgacagccaattcatacccatgataacatcaaagtccacaatatcaagaagtacgagatctacactagtctcaagactcccaatagtaatcacacacaagcgatagacatgatctatattaatagaatctcccaccagcgtggacacatacataggagcacccaaagaatcatgaggcacaaccagatatgaagcaaaatgggttgacacgtaggaataagtagagcccggatcaaatagaactgaagcatctctatggcaaaatagaacaatacctgtgatgacaacgttagatgacgcggcctcaagtctagttaggaatgtataaaattgaggctgggccccaccaccttgaccttctcccctcggacgacctctaaccggcttgcctttacctctaatggcccgaccttcacctctaacggcctgacctccacctctggctgtctgacttctgcctctagctagctgagcaggcggtggaccaactagtgctgaaaacatggcacgagaactctgatgtggcatgctgcttaacaatctcaaacagaatctcctgatatgaccagtacccccgtactcaaaatacccatcctgctgatgtggctactgaagcttaaacagaccagaacgggcaggataaccacggtggtagctgtagataagaggcgcactaataggagctgatggtgcattgtaggctggctgcccagaatgagatacataaggagcacgactccccgaagtactgtgagatgattggagcgctgattgaaatggcctaagagaatggaatctaccaaaagtaacactgtcccaagatgaggcaccactgaaaccaccggaatgacgaggcctcttatcagacataggccccctctcctgaccacaaagcatctctagtctccttggccatctgtagcctgatactgaaagttagcccatcaataaatctcatcactctctccctcttagtagggagtaacacaatggcatggcgagctaggtccataaatcgagtctcatatagggtaatagtcatactaccttgctgaagacgatcaaactgcctgcggtaatcctctcttagagtaaaagaaatgaacttctctagaaatagctgtgaaaactgatcctcggtaagtgtcgacaaaccagctcgtctagtcaacatataatccctccaccacctcttggaggaacctgtcataaggtaagtgccgacgaaccagctcgtctagtcaacatataatcccttcaccacctcttggcggaacctgtcatctgaaacactacaaagccgaccacattggtctcaacaatacccacgttgcgcaatacctcgtggcagcgatccaagtaatcatgtgggtcctaagaaggtgcactaataaaatgaataagaaagagcttggtaaacttatccagcctcaacaaggcctcagaagacatagctagcctatccctggcccctgccgccacaaccggctgaaccaccccaacttgttgggctattgggtttgatataggggagccacctactccggggtgtgagtgagtagcgggagtctatgctccttccctaacctaagagacggctggtgccaccagaaatgcaccagtctgggccatactctccataaggcccataagaggactgtagcgtcctgaagcactggaatggatataaatctctccagatcctgagttggtgacggtacagccagagctggaacttcctcctcatgatcaatcagaggctccactgcgagtattactgctcaagctctaagttgagctctccctcaacctcagcctctggctcaacctctgcccctggtaggagctgccataggcggctctggctcctatccggctgctaatgacgagcgtgttctcaccatctgcgagagaacgaaaatagaacagttcaatcatcgatagagtgaaatcgcacgatagagagaaaaaagaagtgaaatttttcctaaaccctagacactctggaagataagtaaagacttggacaacctagtgctctgataccaacttgtcgtgacccgaaatcccagcctcggaatcgtgatggctcctaaaatctacttgctaggcaagccgacgtgaacagaaaattaattaactaattttaacaattttatgacaagataataacaattaaaatggtacaagtccaaagcatagtatgataatactgaataacaatcctatacagagccagaaactggtgtcacgagtatatgaacatccagattgctacaaacatagtctgaataaaatttactattttgaaactcagaaaaaatagtaaagataggagggaaggtgacttcagggctgcgaatgatgtgcagctataccttgggtctccatgaagaactggatccgagcaaatctactgaacggcactatgacccactatgaaatctgcacaagaagtgcatagcgtagtatgagtaaaaccgaccttatgtactctgtaagtgccgagcctatcctcgacgaactagtgacgaggctaaggtatgccacttataatgcataataataataataataataataataataataataataataataataataataataataataataataacaaggaaggaaaacaagaaataaaagtaaggaaattaatttatgaaaaagaattcaatcctcgcagtcggagaacccaaaataaccgatctcataatttcatgtaaaatgttggaaaacaaacacattaacaacaacaaaacaacatacacatccgttgcagcgcaacctgatcccacatacacaatcaatccttctttattttaccataacatcatttatcaatatcaagaatcatatataaaatccgtttcaacgcgcaacccgatcccactatatcatcataatcagtgtcataatcctcccttatttcaccatgtcgcaaccgttacagcgttcaacccgatccacaaataatttcaatatatgtaatcaatccaacagctcaattcacgagaatctctatcattaaggaatacgaaaccaaagaaataaaagaaccatatactaatcaaaggaatgctacaaataatacactaacaacaagagaagccaattaagtaaaaattaaggagtgcaagtaagacaattaagtcaagtagaaattaatcactgagtcatggaagggacgaacattttaatacaagaataattaatgacaagtaaaaaattatggcatgggaaagtaattaaaacatgtaacagttaaggcatggagtgagatgattcataaaaaacgagaaacatctagaaacaattaatttgatggtgcatatacactcgtcacctcgcatatatgctgtttcacctcgagcccgattatgtgattagtttcgaaatctgacctcatttgaggtctaaatctcaattttagaaaaattcccaattacacccaaatccctaatttctaccatgaaagatcatagattaaaggttagaaatcaatgggtattgatggaaatggaagaaaataaattaaaatatgctaacctataaagtggggatgaaatatctcttaaaaatcgcctctaggacgagatcaagcttggaaatggtgaaaaatgagataaatcccaaatttttaaagttttaaagactggaaatcaggcgttcttcgcattcaggagacacctgacgcgatcgcgaagtagcagcggctaaaggcattctcgttcgcaagccactcttcgtgtttgcaaaggcttactcccacttgccttcgcattcgcggtccttatgttgcgttcgcgaagagtaatgcctaagctcccttcccaagccccataaccatacacgttcgcaaggggctggtcgtgttcgtgaagggtaaacccccagtccttcacgttcgcgaccatgtcatcgcattcgcgaagcacaaaatgacagacaccagcaatagtaaaaccagcatgtgtctaagtccaaaattcaatttgtagcctatccgaaactcacccgagcccctcaagctcaaaactaaacatgcacacaagtgtaataacatcatataaactctcttgcctgataaaaataccaaaataatacctagaactacgaatcagacatcaaaatatacgaaatttgcgaagaagcttaagaactttcaattttacaaccggccatccgaatcacgtcaattcaactccgttttacaccaaattttgcagacaagtcataaatagtgaaatgaacctacaccaagttccggaaccgaaatccaaacctgatagaaacaaagtcaacatacgatcaatcttaggaattctttaagcctttaaatgactagttttaacaaatcacattaaatcaagttagggacttccaaattcgattccaggcatacgcccaagtcccaaatcacgatacaaacccacctggactgttagaacactgatccgagtccgtctagacaaaaatattgaccaactaatttaaggttaaatttctcattttcttgaatttttaacacaaaaggttttcctaaaaaacacggactatacacgcagattgaaggaggctaaatggagctattcgaggtctcggaacacaaaaatgaaggctaaaactcaaaatgacctatcgggtcatcacaattatgttgtgtcttatacgagtatgctctttaatcattcatcattcacctaatatatgtgtactgtagacgcatacaagtgggggaagttgaaggggctatgcgcaggatatgtaggggtaaagcgaccaacccagatgagattcttgttgaattttggaaacgcgtgggcaacgcgggcctagaatggctctctaggttatttatcatcatttttaggatgaagaagatacctgatgagtggaggtggagtgtgatgattccattgtataagaacaaaggggatatccagaactgcaacaactataggggtatcaagttgttacgatgaaagtttgggagagagtgattgaagggtggatgaggatgagtgtgtccatctccgataggggtatcaagtttttaatccatacgatgaaattttgggagagagtgattgaaggaatgatgaggaggagtgtgtccatttttgagaaacagtttggtttcatgctgggacggtcgactactgaagccataaacatcgtgaggagattagcagagcagtatagggcggtgaataaagatttgtatatggtgttcattgacctagagagagattatgccaaagtcccaagagaggtcctattgagatgtttggaggctaagagagtacatgtagcatatattaggggtgatccactagatgtatgatagagctaagacacgggtaaggacagtagaaggagactctgagtacttcccggttaagatggactgcatcaaggatcaacacttagcacgtttttgttttacttggaaatggacgcgttgacgtgacacattcaagaggaggtgtcttggtacatattatttgcagataatatagtcctggttgatgagacgagcggttgtgttaacgagaggctggaggtctagagacatgccctagaatctaagggtttcaagtttagtgggaccaagacagaatacttagagtgtaagttcagcggtgctacccaggaagcagacaggtttcaagcatctatggtcactaattcagaatgatgaggagattgatgaggatgtcacacatcgtatcggggcagggtggatgaagtggaggctcgcttctggtgtcttgtacgataaaaatgtgccattgaaacttaaggataagttctacaaggtggtggttagacctactatgctgtatggggcagagtgttgtccagtcaagaacttccacgtctagcagatgaaagtagctgaaatgaggatgttgagatgaatatgtgggcatactaggttagatagagtttggaatgaaattattcaggataaggtgggagtggcccttgtgcagaaaaggatgcgagaggtgaggctgagatggttggggcatgttaagaggaaaagcatagatgccccaattaggaggtgtgagaggttggccttgagggtaagaggaagggtagagataggccaaagaaggcttggggagaggtgctcaggcgagacatggcgcagcttgagcaaactgaggacatgatcctggataggatggtgtgacggttgaggatgacggttgaggattagggtagaaggttagtaggtagacatgtgtttccctctgtcttcagtagttcattagtgttagtattagtatggtacccttttatcctgagtttgttattatcgcatatcttgttatgttattacttgtcaccagtactttcttagtttgctatcagtactccttttatattctctattgctatcagacctcgggtttagtttctctaaatagattatcttgctattacttgctataagtacttctttcatattctttattgctatatttattttcctaacatattatcttgctatgtattgctatcaatgcttcttccatcttctttagcctatggtctatcgaaaacagtctctctgccctcctaggataatggcaaggctgcgtacaatataccctttccagaccccacttgtgggatttcactgggttattgttgttgttgttgtcatttacctaatatatgaaagtcttactaatccaagtgagaattctcagtcggggagccttggcgtaactggtaaaattgtttccatgtgaccaggaggtcataggttcgagccgtggaaacagtttattgcagaaatgcagggtaaggctgcatacaatagacccttacggtccgacccttcctcggaccccgcgaataacgagagcttagtataccgggctgtcctaaatgataatttcgagagatctgaataaaacaggaaagtcaaaagaaacagagtatttccatgtctataataatgtttttttatttttattttatttccattgtcttctcattatgggttattgacgaatatgaatatagctggtgagaattccagaatactttgtcaactatgttgtttttttacgcgtcattaagtgaatatattaaagaaaatttatccgtagttttttaaatcttgttgatacaatcaaacatctctataatagccgcatttgatccaatattttttggatgctataattaagtgttgttatatagaatatatattataatatagcataaaagatcagttccgagaaaacttcacttttatagtgaatagttgttatatagggatgttataatagagatgtctgactgtatatcttttgcgcttaatgtattttattgcagagtgcacctatgcaagaactagagggttatgagcttgttggcatgacgttggagtaccgacgtgagtgcagaagagacagtgtgctacaatctctcacatccgtattgcaaaatgcagttggtaatttggccaactccagtaatgttaagtgtcagcatttgcttcgtttggagagtggcgaagacgttgtgaagggaaggactgaatggaggccaagatctgccaacagaactaagaattgggtacaagaatctgaagattactcccatgatcttcattcttaattgcgatttataaatcatatttagcaaatataaatcgtattttttaattcgatttataaaatcacattattcaaatgcgacataccatcttaactagcttataagattgagttggtacacatagttcgttcctgtaaattttctattagttattacccagatagttttgacgaatcggccagatatggggagggggttgaaacaggttagacaaaacactagctatagggtgcatgcaatcaaacactatcctaaaaaaaatgaaatgcaacatagtaacatagaaataattataaaacgaaagaaataatataaatttcaattaaacatagagatgacaattacattaaaaacaaaaataagacatacataactaagttctcaggtaataaaaataaacatgacatgaccatccatatccataaaactaaatatactagaacacacacaaatcagcatacatcttcatattccttggtaattagttgtgaggcttagcttcagttactttatcctgcaagtcttcatttcctcctccaaatccagctccattttcattaccaggatatgctccgccacaatatccaccatatcctcctccacgagatcctcctcctcggaatcctccacatccgcctcctccagatcctggaactccagatcctagaagtttggtgtcattttcctcatttttcttatcagataacttttttgcaagaatgtgataatcatgcatatgcatgttaggttgataattagccacgcattttcaaaaacattattagctacggaagatttagcgatagattagggacgaatttgataggtaattcctattttttttgttagtagactttttagataaatctagttgttaagagcagaagttaattaatgcaaaataaatcaagtccataatgaccagaaacataagaaaataatccatctttttgtttggcgttgttaataatttcaattttatgagttcaagttcgggacgttgctgtcggactcatttaatttattgggtttaaaatcaattatttgcacttgttttataaatcatttaacacatgtataagattctagtgaagcttcttggttttgataatcccatataactcacactacgtagcccctttgtttgactgacaatgaagttcaagaaggaaaaaaaaagatttataaaaaataatcaactctaaaaaatactataagagacttttttcctaattatcaaagtgatcatcaaattaattatttttatatattgcatgtttattatgagaataacctatagctcattccaaaacaaataatcctatgtttcaatttatttgaacttattttctttttagtctgtgccaaaaaaaaaatgattaatttccatatttgatatccattactaatacttttatactatgtaccaatatattttaaagtagggaattttcagggcctaaaacaattgctttagtggcttttcccatagccggcctaagcacaagttactgcatatattgaacagttggtttattataaaattcaagttattcattccaacatatagatatataaattttggtgtcctttattaatgtaatgacccgattgttcgttttgagcatttgcacttcgctcggtagtttacgggcatgagtagctccgtataatgtattatgacttgtgtgaatcgtcggtttttattttcaggttattcggaatttatttggaagaatgattctcaactagcaagctttaaattaggagagttgatcaagtttgactttttagtttttgacctcgaattggggttcatccggctgtcacgaccccaaaccggacccggtcgtgatggcgcctcttgtgaagacaaggccagccgacacaattccccaagtcaaccattttctattaaaagttatttttataccatttataaattgttaatctcaaaatgaacatttaaaagaaaaatgtgaaataattacacaagcccgacatcggggtgtcactagtcatgagcatctaccaaggtctgaatacaacaaaaacagtaaaatgtgctaagaacagaaatgaaaatgagaggaaggaagcggtgctgcgaacgtcgtgcaaccaccttgctaactctgatgactctgcatctgagcaaccaacacccgctaccgggtttcgaaatacctgaatctgcacacgagatacaggaagtaatgtgagtactccaacccagtaagtaataagagtaaataatgactgagcagtaggaaataatgaatccacatttatgttaaactcaataagcacacaggctgctaaatcagaatacgagtcaatctcctcttttaaaatcctgcttttggtaaaaatcatataaaatgccttccggcatattcagtaggggtttaataatattttaataaaagagctgaaaaccataatcggcccctcgggcaaaagaagagtcataaacacctcctaacaagaaaatctcagtggaaataacaaaaaccaaatcagtgattaagttctgaacatctcataaaccccagcttaaatgaaagttgtttaaaaatatttatctaacattttcgacagaagctcagtataaagatgagtgaaaacagtcattaaatcaacatattcgatagaaactcactctaaagagaagtgaaaatcaataagttcataatcagacccctcagacaaacatcactcatgtgcatgtagatatctattgcccctcgggctagcctctcagtcactcgtgactcaactcctaccaatcagcgctcacactcagcacttatgctcaataggtaccatatattaatagctgcggcgtgcagcctgatccatatatattattgactgcgctcactgggggtgtgcagactccggaggggctcttacagcccaagcgctatatcgctgtagcgtgcagcccgatgcaacatatcgttgcgccgtgtagcccgatcaatatatatatatatatatatatatatatatatatatgttgctacggcgtgcatcccgatccatagatatataatcctcacaaccaggccctcggcctctctcagtcattaaccttacaatcctcggcctctctcagtcattaacctcacaatcagactctcagtctatctcagtcatcaacctcacaatcagactctcggtctatctcagtcatcaactcacgatcacttggaccatcagtaaaacagggaacccagcccaaacagttttcacattttaaaaaaaatatagtgataaaaccagatttaaacaacaaccaggtaaaaacatgactgaggatatgcgttcaaaacaagtagagtgacaaaaaatagtaaaaatgcccttaagggtctcaacaggtcggcacaaggcctcaaacatggcatacaacacaaaatataatatcaatctctagaacatggaatgtcctaagatttcaaatcaaatacgcgacttaacaatcatacggaacggaccaagtcacaatccccagcggtgcacaactccacgctcgtcatctagcatgtgcgtcacctcaaaataacacaacgatgtgtaatccggggtttcaaaccctcaggatagtatttacaatcattacttacctcgatccggtcaaaactctagcccgcgatgcctcgcccacacgaattgacctccggatgctccaaatctagccacaatcagtacataattattaaaatatgctaagagagcgaagcccattcgaaaatatccaatttaacatcaaaatcccgaaattgctcaaatccggcccccaggccaatgctttgaaatccgacgaaactcacaaaatccgacaatccattcaaccacgagtccaaccataccaaaattactgaattccgataacaattcggcctccaaatcttcgaatcttattttcaaatccctaggtccaaattcccaatttacacctcaaaaacatgtaatctagtcggattattcgatgataattcaatattatggagtagaagtgatcacaagtgacatacctcaatatttcccatgatttcttgctcaaaaatcgccccaagccgtgttctttcaccaaaaaagtcaaaatgagctaaaaaacgtaacagctttaatgaatccgattctggtctaaaggcttaattcccatcgctaaaaggtccaatctggtcgctgaaaggtgcacaccaaatctgatgcaccagcagtcttaaatttcactaaaaaggctctaactccatcatacgaactcggaattcgatgattcttgttcctatgagtcacaaataatgatacgaacatagtccttcaatcgaaactcaattcggagctcgtttgctaagtgtgatatccatttcgctcgttaaataattaactcatgattcgcgtcaaaaacccaatcgctacttgatgaaattagaccaaactttccagatcactcctataattcattatcaaaattctggaagtctcagaatcaaatttcgatctctagaactgaaaatggacctttggatcattacatgcttatgctcaaaacgccaaaatcttccaaaaactcttccaaaacatatccgagcctcatgggaccccgaccaaacatgccaacacaccccataacataattcaaacttgttccaaccttcggaacgctcaaaacaacatcaaaacatcaaatcacccttggattcaagcctaagaattccaaaacttccgaattccgaattagatcaaaaagtctatcaaacctcgtccgaatgacctgaaattttgcacacacatcacaaatgacacaatggacctactcccatttttggaattccattccgaccccgatatcaaaatttccactgccgaacggaaaatgccaaatttccaatttcgccaattcgagcctaaatctaccacggacctccaaaatacattccaaacgcgctcccaagtccaaaatcacctaacagagctaaccaaatgatagaaatctaaatccaagatcaaatactaaaaagtcaaaacttggtcaaacctttcaaatttcatgcttcaactgagaactgttcttccaaatttatcacgattaacctgaaaaccaaaaccaatgatttacataagtcataatacatcacacggggcaagctatgcccgagaactggtgagtaaagtgcaaagtgcaaaagctgaaaaaaaccggtcgggtcgttatatcctcctccaattaaacatatgttcgccctcgaacgtgaccagagttgttctaaaagccaaccaatcgctgaataaccttaccatgcatatacccggtatgatcttacgtcaccctatctcatataggtccgataacacaatgaaactgcatttttcacatttcaacctagcccataagccttaaaaccacatttccacttcggacatcattcacaagatcagaatctcacatctatattctgaataagcccaaaccagctgtaaaaaaccatacctgcaacctcggatgcaattccatgataaaccacgtaactcaaatgctggttgcgataacttctattcacagcagctgcacatagcacccgaataccgatagaaaaactcttatcaactaaagtctcatcccaacactttcatatactaccaatgacccctaaaacacgcggtaagccataaccatttcccagatcaaccattcgtgaaacttcttccttggcaaacaccacagcaaattttctgagccgaacctcgatattatccttccaacatgctaaaatcgaatccgttcatatttattgatgaccccaacgatctcctctaatccaacactactctggtgacatgacacatcaatacaggcctaagcggcagcttgcacaatacgcgcaccaataagcaatagtccgaacatactcaaatcatgaaaacagctcaaatgaaagagctgtacctcaagattaccagtaccaccagaacacacggctgagaacccatctcacatcataggaacagaacacacgaatctaacccgcaaggtcataactgatgcgccatccgccaagaaatatccaatacttctcccgctcgactcccactatgagaccccaatagaaccgtaccatatgtgcctataaccaacaaatcataacacctcgcaacacagcaaggtgactcatagacctccccatattactaataagctcaataataatcgaatcaacacatccctcaacaatacaattcagggtcaacaaagccgtcccgatgcaaaacacgcatccatataagtctactaatgaaccatacaccaactctagtcactcacaatagataataaccctccaaaggttcacaatgactgaattatagcacatactattatctgactaacttacccacatctttaccatcctcaaccacgagctaacctgcttatgagaacttccagtctccaagtccataaagcacatgaattaccatatctgatcccaatttcaccgctcgaatatacaacacacctctaatactcaatcatcccacgagaggtacacctataattcttctgtgccacctagtaaactcgcatatcatcagtcgataagacaagacagtgccgcaatatcaataaagcatccataactcaaacacatcgccctttataaaatgtataccctcatcaagcaacaccaatcagcaataccttttccttaatcatctgaaattgcccgtgctgcctaagaattttatgtccttcctttcagaactgaaccgtaaccttactcacgtaattctccatcctccataacatatcgcatgtgtcataccatcctaggatatcatgagaacttcatatcccttccgagccacaggcaactatgtactcaactaaccaagaactttccattgatcccatctagaagaaaaacactatacatcccatgctcctcatgctcatagaaaatatacatctctaaccgtggcagaaagctatcaagaactcaccgaatttcatttgcacaaactaaaccataaggactgaatccttctaactcaaccaagctatacaggccactaaaatccaagagcattgtcgttaaacacttgtataatctcattacctcataggcatccaaagaactaaccatatccttaccacaccgatccgggccactaccaagctatcccatctatccgagttcccttctgacttaccttcaacttgatactccttcttgctataacatcacaatttctcaaccaagacttaccacacgagacccaagcacaaaaccacaccgtctaagactcataagccgctgaatactctcttaaatatccctaaaagcaccaccttcaaaatacttaattctgaagagacttcctacgaatctaaatccgttacctttaccttcctgatactgatacatagaatcccacaatttatagaaaataccacaagtcttgacatcttccaatgaaaactcagtttctaaccacatatgcaactttaaaatacccaattgttatatgtagaatcttgaacacattagaaccattctcgcaactcatccactctactcaaaccgcaattagcccgatcaaaagaaccgaacaacctatgcttcattagcacttcagacactgcagaatgcaacctcatcccaatacaaccaagcaacttcctgctctatgcaccgagcatcttttactaacaaaaacttacgacattctgagattctcttatacctatgaagcatgacataacctttgtcaaaattttcctttactcgagacatcatcggtctcaatctctataagccataactgattcaccagtacgcctcaaactggaactaacatagcacataaccgtgcaatcgcctaatcaatagcagactcctccacttggctcgaagccatagaccaaaacacacacaataactcataacgcatataccccattgctgccataataccatagtaaaattaaactcaatcattcataagctcatgaaacacagaccatctggtacttgaaatcttctacaaatctcgcattcatcctcgcaacagtcaagcccactctcttaagcgacccaaatttaaatttcaacacatatttttcacttgtaaatgagatcttctaacagaccacataaggatcacacaacctcagaacactccgtaggagataacccacctgctttgcctccaactaacattttcgtataccttccaccgtcataaacattacgcagtcacttagtcttcctgagtccgaactcataccgtatcatgacattttttttacttcacttccacaaggaaacatggaaagattcttcacacgcccataactcgaggctatacctcgaatcaagatggaaatcaagcacctaatagttcttctatcctccagcaaacctttctcgtcacttccaaatcatatgaatacatctcgcagtcacatcatactcgtcacgtaactatctagtcatcacttcccttaatagggacacaacagcacatatagatctagaaacatgcgctcacgcaaccaacacctcggtgctcaagctataggcaaaaatccggcctcaagtattccagactggcccaacatcaacacacagagatcacatctcgccccttgatcagggaatcacgagccatcgatgcaaatctgatactgagtgctcatgcgcgcacacgaacgcatggaaggaattgaaagagttacattttcaagctgaatcaaaggacgcacgataagaattcaagaatgtgaagttttcctaaaggttctgcagcctctcgaggataaatacagatgtctccgtaccgatccgcgagactctactaaacgtgctcatgactcgtgagacctatgtaacctaggctctgataccaacttgtcaccaccctaaatcggacccggtagtgatggcgcctctcgtgaagacaaggatacaattccccaagtcaaccattttccattaaaagttatttttataccatttataaatcgttaatctcataatgaacatttaaaacaaaaatacgaaataattacacaagcccgacatcggggtgtcactaatcatgaacatctaccaaggtttgaatacaacaaaaatagtaaaatgtactaagtacagaaatgaaaatgagaggaaggaagcggtgctgcgaacgtcgtgcaaccaccttgctaactcggatgactccgcgtctgagcaaccaacactcgctaccgggtttcgaaatacctgaatctgcacacgagatgcagggagtaatgtgagtactccaacccagtaagtaatgagagtaaataaagaccgagcagtaggaaacaatgaatccacatttatgttaaactcaataagcacacaggctgctaaatcagaatatgagtcaatcacctcttttaaaatcctgctttttgtaaaaatcatttaaaatgccttccgacagattcagtaggggttcaataccatttttaataaaagagctgaaaaccataatcggcccctcgggcaaaacagaagtcataaacacctcctaacaagaaaatctcaatggaaataacaaaaatcaaatcaatgattaagttctgaacatctcataaaccccagcttaaatgaaagttgtttaaaaacatttatctaacattttcgacagaggctcagtataaagatgagtgaaaatagtcactaaatcaacatatacgatagaaactcactctaaagagaagtgaaaatcaataagttcataatcaggcccctcaggcaaacatcactcatgtgtatttatatatctatcgccccacaggctagcctctcattcactcgtgactcaactcctaccaatcagcgctcacactcagcactcacgctcaataggtactatatagtaaccgctgaggcgtgcaacccgatccatatattgctgcggcgtgcatcccgatccatatatatagtcaactgtgctcactacgggtgtgcagactccagaggggctcttacagcccaagcgctatatcgttgcagcgtgtagcccgatccaacatatcgctgcggcgtgcaacccactacaagaacattgacttttaacgaccaaattctaacgaagagattttaatccggtcgttataagtgtatatatgacgaccaattttatttccggtcatcaaaatcaattttaggaataatattaacgaaaggataatttttggtcattaaaaataataaaatccagacgttaaaataacaaaattgggcgcgattttttccctctttttctgcacaacccacaactgatccacgcacccctcaacgatctctttccaccctcgcctgcctccccccctccccacttcactgtaggttttatataagtatacaataacttatagtagtagtttgctactgtgacgacccaatggggtcatcaccttaaatgctccttattccatgcttcagaggccttaaagacctcttgaaaggtttcctcgatttgcgtgcgcagtccgggcgcgaagccggaaagattatatatattgaaaaatgaattcttagcttaaaatgatgaattttgagtataaccttgatatggttgactccggtcaacattttgggtaaacgggctcggacccgtgtcggattaatttctgtagatccgtcatgaaatttgggactcgtgcatatgcccggaatcgaattccgagatcccaagcccaagatatgagaatttttgtgaaactagcttttgaaattggcctaagcctttgaaaatgataagtcgagagttgaaggtcgtatcgggctcgtattttggttccgacgcccggtacaagtcttatatggcgtttaagcgctttctgtaaaatttcatgtaatttggacgtcgtttgacgtgtttcggactagaaaatctatttttgagaatttgaaagttaaaggttgaaatttatgaaattgtggcttaattctatgattttgatgttagtttagcgatttgatcgctcgagcgagttcgtaaggtgtttttgagtaagtgtgagtggttggttaggagccccgagggctcgggagtgttttcgggggtggttcggaacatttttggtttgaaatctggtgtctgcagcctttctcgcatttgcgacaatttcttcgcaaatgcgaagtccttgtgtcctccgtcattctcgcaattgcgaggctttcgtcgcaaatgcgaccagcccttcccctttcccagttcgcaaatgcgaggcatatgtcgcaaatgcgacgcctcttccgttccctccttgttcgcaaatgcgaaactctagtcgcaattgcgacttccgcgtgtcctctgtttccatcgcaaatgcgaagatatttccgcatttgcgagacttccctcttggccagcttcttcgcaaatgcgaagctttactcgcatttgcgagatttcccctttcctgcctggtttcgcaaatgcgagatctgcacctgttaaatctatacttagacgaattttgaaccccatttcataacatttcaaaacccaaaacctcttaggcgattttcctctcaaccattcttctccaatccgtttgtaagtctaattttactcaatttcttcaatcatcatcatcatctaacatgatttcttcatcaatccaagccttttcatggttaaaatggtggaattggtagaacctatggttttcataatttgagcttttggaccccgatttgaggtccgatttcaattccaatcatagatatggattcatgggggaatgggtaacttggttttggtccgaacctcgagtttcgaccacgtgggcccgggggcattttgggaaattttgggtaaaactttgggaaactcatccttatgcattcaaactagtttaattagcatctattaattcatttgggtaatttatgactagatatcgttgtttgggagttggattccaaagggaaggcggtggtagagctttgaattgctaattcggcattgaggtaagtgcttgttctaactctagttcgagggattaggattaggaagttatttgttatgtgttacatgggtcggtgtataggtttggtgacggttacctatgcacccgagtcaaagcatgaccgtgagtctttacttgagatagatgaaagctatgcgattgatctagctattgttttgaaccttgtgaataggtcgttggcttcatatgacttaaattgcttaatttggataagtgaagtggaatgccatgtctagtaaggttgagttctatatgttctcttgtgtcccttgccgggattgattggttatagctgcacccttgtcgggttagataatatgtgtacattgttgtgttttctctgagatagaactagtatataaatgaattgagctgaaagatatgaaaatttgagggcgggtggtacgcctaccacatgataaactgaaatgagggcgggtggtacgcctaccacaggatatgataaacatgagggcgggtggtacgcctaccacaagatatgacaaaaaaaaagagggcgggtggtacgcctaccacaagatacaatgaaatgagggcgggtggtacgcctaccacaagatatgcttatacttgatgttttacttcttgttggctacagattatctgtttaattatcttgtactttgatttattgcactgtttccccttatagtatgtcccctcccttacttgtttcattcatgtattatttttccctgttttgcatatatgtatattctgcacaggttaacgctgtaggtcccgtctagcctcgtcactacctcgtggactggggttaggccaggcacttaccagcacatggggtcggattgtgctgatactacactttctgtgcctttttgtgcacagatccgggggcagcttttggacagcagtaccagcagtagattgggagcgcgccttcagtccagagactattaggtagctcactggcgtccgtgggtccttggtctcttctgtctttgttatttagtccattgtattcggacaagtatttcatgacatttctttctttgagccgttatttgtagtaactcctagtacgtctgtggatactgtgacactaagttctgggtagaagtctgtaattggttcttactttccgcaattttggccatgttatgttatatatacgatgttcttccgcacctatttcttccactttaagttcatattgttaattaataagttattgtgattgcgctaagttggcttgcctagctcccttagtaggcgccatcacgactcccgatggtgggaaatccgggtcgtgacagctacagtctacagagcaattaatagctagcatatcacaaattgaactctacaaagaatcacaatttgggttcctctctgcaacctaggtttcattctccttctcatcaaggtaagctctaaacatatagtaaattattttgaaattgggcacttttttatattatcggttctctctttgtttttcaaatattgagtttcttcttacaattacatatgcttcaaatttataattacaggtacgatttatgaatattgatgttgaatgtgcagaagttatttctttatttccattgaattttgctccttacataatagctatgtgtattcatctttagagcagattattttttgaaattgggtttgattgcatattgttattgggaaaaaagcttgtcaatatttggtcatgattgtattgtaaactttttgatctttggccgctgctgctaaatttgatactcacttgctcttcgctcattttttttacctctttaaagctgctctacaaaacatagctttctcagcctttgttggtttcttaaccgaagcagaggcattttgttgttcattccggtatttaacgacagttcgagttagcgcttttgtggtcggagttcggtagatacaaagaccctcgcctcagttcgctgccctgcaaaaggtctgtatatccttctctttgctctagttttcctcttttttttattagagcatgttcatacttgatgtgtgcttgttttaagtgccgttagattctgttaagcttcacgttttgagaccacaaacataggtgttgaaccttacgtctatttaatatgatggaattattctatacttaaacggttattaaaaacaatattttttgtaggagattatattcttgcgcgtattctttgaaacatactttaactgatatttgataaaatgcttacatgaaattactctgtttttctttgtgtacttctctgttagaagtcataatttagggaagagttttcttttcatgaattaggcacgtaggaaaagactcattactatttgtgatttagaacccttccacttggacattatgcctaaggtttctaacactttgtttaaaaatagcttcagttaaatgaataccatagacaacatgtccataggaacttattttgattcactgtccaaaaagaaaaagagaaaaaaatgaaattcttttcttcatcactactgcaagtgttggtgaatgaatatagattatttgttcattactttaagaagatagcacttggacaataatttactgcttatacattgaagaaatcatacctctgttagagtgggaatacatttaccatatacagagaccatgagtttggattctctttatttggaggtttagatatcatgcccatagggattaagtggctttttccttaaaaactgatttagtagaatacatttaggacttctatggttatattttgtattagccatgttagatttcgctaagatgaaccttttaaatgcttctctgtaaccccgaccgagttcaaaatgaagtagtaactttcctcgatttgtttagctttgtcataaatagatttagatgattgttgtgacaatatgatacacaataattaggattccccttgtaagtgttaaaatttagctaaatgttgcatataaagattaaaatatttctagcagcaagtattggtagtttggtctcatattttattaccatgaaaggatatttgaaaaatctatgttagatcctgtgaagttggaatgaaaaaaaaaaatagaaacttgattgctatttgagttatatggtattttgatcttcaatagctactaaaagttgtgtacttactgcatctaataaattagcaagaataatatgtgattatctcataatatacaaatggagaagagtgcaagtcatgttagattacattgataaagatagtttacaatctaatgtattcataaattcttaattaacatgttaaattatttatgcaactatatgaatattcatagattcttaatctatgtaaatgaattttattccatttacttcttactccttttgcattattttgttaatataattgtactagattatggcacctgacaaacaatggatgcaacttattcatgatcgacttgatgatgcttataaacttggggtggagaaattcttggattatgcttttacaagactaggagaaacacacacaatacgttgtccatgcgtcaaatgtggtaatgcatattcaggaacacgtgagcaggttaagtcacatttaatagtatatggaataatccaaaattatactttgtggtatcaccacggggagaggttaggtgagccacattcagattctgagcttgcagatgataatgatgttgaagatagtgatggtgaagatgaaatacatgggattttaagagatttataccccaatttcgatagagaaaatatagaaacgggcggtgatgattttgttgaggaagaaccaaatccggaagcgaaaaagttttataggctcttaaaggattttgatcaaccactgtacgaaggttcaaaaatttctaaactttctactgtgataaaattgcttcacattaaaagtattggtcgttggagtaatgagtcatttacaatgttgttgaaaatgttgaaggaagatttgttgcctgatgaatcaaacttgccagcttcatattatgaagcaaagaagataattcgggaccttgggctttcttgcatgaagattgatgcatgtaagaatgattgcatgctatatcggaaagatgatgagcttcttcagttttgcaaagtttgtggtgcatctagatggaaagaggataaacatagcggggaaataaaatgtagaagtggaaaaaagataccatacaagattttacgttactttcctctaaagccaagacttcaaagattatttatgtcctcaaagacatcttctttgatgacatggcatcatgataaaagagttgatgatggtataatgaggcacccagctgattcaatagcatggaaaaagtttgatgaacttcaccaatcttttgctgttgagcctcgtaatgttcgactaggacttgctacatatggttttcaaccatttggaaattccaaaactccatatagcatttggcctgtggtacttattccttataatttaccaccttggctatgcatgaagaaagagaattttattttgtcgatgcttatccctggtcctgagagtccgggagatgctattgatgtttatctccaacctttgattgaagaattaaaggaattatgggatactggagtggagtcctttgatgcgtcgactagaaagaactttatgttacatgcagctttgctatggaccattaatgattttccagcatatgcgaatttgtccggatggagtacaaaaggtaaattggcttgcccttgttgcaataaagatacttactcaattaggttagagaatggtaaaaaatagtgttatttgggccatagacgctttcttcctcttgatcataaatggaggaatgataaagagtcatttgatggcactaaggagagacgattaccaccaaaaatattatctggcgaagatatacttggtcaagtggctgatttagatgggttaaaactaacaaaggatccaaagaagaagattaaaatatcacatgagagcaggggtgataattggaataagaagagtattttctttgatcttccatattggaaaactctattgttgcgtcataatttagatgtgatgcatattgagaagaacatatgtgataatattttggggacactcttgaatatcaaaggaaaaaccaaagacaccataaaaactcggctagatttgcaagcgatgaatataaggaaagaattgcatccaataaaaaaatggggataactatgacttaccaacagcatgttacactttatctcctgaagagaagtacaagttttgcgattttttaaaaaatctgaaggtcccggatggattttcatcaaacatttctcagtgtgtcaaccttaaggatcgtaaaatttcaggcttaaaaagtcatgattgccatattattctacaatatttactcccacttgcgatacgtggaatgctttgcaaatctgtgagtgaaccacttattgagttgtctttatttttcaacattcttggagcgaaatgtttaagcatggaagaattagaacaaattgatggccaaattccgaaaactgagtgcaagttagagaaggtattccctcctactttttttgatgtcatggagcatttgccaattcatttagctaatgaagctaagattgctggacctactcaatatcggcatatgtatccaatggagcgatacatatactttatgaagtctttagttggtaatagggcttgcccagaaggttctattgcagaggggtatttagcaactgaatgtttgaccttatgttcaaggtatttgcatacaatggaaacaaaatttaatcgccttgaacggaattgtgatggtggtattgtagaatatgatggaagtttaacaattttttgtgaatctggaagagctttaagagatggcaaaccatgcagacttgatccatatgaattcgagcaagcacatatttatattttaaagaactgtgatgaagttcaaccatttctcgagtaagcaatgatttaatccaataatttaattatacattctctaacttttttatttaaaacgacatattattcttcaatttttgtagagagtttacacaaactccagctaataactctcaagaaacttcggatcggcaattcattagttggttaaaagaaaaggtgagtactaataagaaattattagttttcaaaccaagtatgcaaatagtatttgttaaattatgtacttgttcatgataggttgcaggtctgcacaacatgatgatagtaagaaaatgacagatttggtctcattgtcacgtggtcctatgccatatgtaacaagtttccatggctacgttgttaatggatataggtttcatgtgcaagactatgataaaggtttaagaactcagaattgtggggtggttgtagttggtgagacagatgaagagaataaaaatattgattactatggagaactaaccgagattcttgagttacaatttgttggaagcggaagagtggttttgtttcgatgtaagtggtttgatatatatgaccaagaaaagggagttaaaatagatgaatatggcattgtaagtgttaaccgccaacgctttctgaaaataaatgagccttttgtattagccaaccaagcatcacaagtattttatgctgatgatctttccaataaaggatggcatgttgtacgaaaagttcaacctcgtgattttgttgacattatgaaggaggatggtgattttgagaagttagataattctacacaaatgaaaaggaaaagaactaattaaggtttggaactttatcatgtttgcttctaatttgttaaactctttacgatgtttaacgtaaagagtcaagatacggtgaagtctaagtctctctttcttctggattcttgctataattctgatgtggtccagaatgaaagctgaacctaagtttcccgaagaggcaaaatattgttattgtactggaacatacatgcggaccttaagaagctgttatgagaatgaattgttgattttcgaggaggctgggacaaattattatagagctaggtactttcttggaattgtataaatcttctgcatttactattgcatttttgtgcaggctaagacataattgtagtcctagcattaataagctgtcttgatcttttcccataacagattcgtcatctgcagttattcagagaactcaaatttacttagcacgtctggcatcactcagaaactcttgtctgtgtctctggataatctggaatatgcctaactgtttgggagagtgcttcaggatgtgggaggacagtcagtgcataaaaagataaggaaatattagaatgctattcctctttgcatcggatagacattacggctagagttcaagatgttttgaaagagaagtaaatatctaataagcttgagagaaaaagtctgtatactcttcttttggtgcaaacaacatctgacttgttaaagatccttgaactcttatgaactccttagagcttaaaatataaagtttttataaatattgtatcacctccttggggtgcaattatatctgtgaatagaatgattactcattagagtttttatgtttatgttgttggaaacaattgtgaagaattgtggggatattttcatattccagtattatttcttgttaataaatttaggttgtaatgcactcccgtgcttcaaaaagagtcaaagtgctagttggcatcccttttcttattgacaaattgctgaactattttttcttatcaagttagcttaacaacactctgctttcttttgttgtattaggttgagatgaatccatcaaaatctcagaagttaaaaatggaatcaacttcaaagactgttaagcattcatttgttgcacctggcgccttagcaaggggacgagggcaaagcttcagaactttgggttcggtaagagtaaacgctgaacagagactcccgattggcaaaagtaaaaatggtaatgcaccagcttcttatctgaacgaactagctcagaataagagtcttgcacctcctgattttgatccactagaagatgatgtttccctcccgcaagaagttgaagtgatgcaagacactcagagaaacgaaataagtatttcactgtttcaagttgtaatatctttttgttgttattgcactgccacttgccacttttttactgtttgacttaaatttaaaattatcaggtccatgccaatctgaaaaggcaaaaaaagtgagaggaaagaacaggtgtaaaaatgttctaggactcaaagttggagaaaagttgagcgtaactttctacaacaatcgagttgttgggaagcattaaaaatcatttgtgagacacttaggtatattagttcgtgaccgtaatatgtgcccactgcgggtacactcatgggcagacattgaagaatataagttggaccatatgtgggaagctgttacggtaagaatttaaagtattatcttgttgttttgccttctccttttcttcgttcacaaatgaaaataaaatactagtgactttacatcattacatctgtcgagttcttatatatttttttggtttatacgaattcaaaaacagaattaaatgagtagaaacatatagtttattgtgctttcctaaagaaccccaatatcctatttcttctgcatcataaactaagaaaaatatccatttcttagcagtatcttttcctatgctctttattgcattttttctcatcatcaaaggtagtaagaaatgtttccccctagaaagacaataatatcctttttttaatacaaaaaaattatcaaatcttgtcattcgttatgttaacgagtactgatacgcttttagaagaaaagtatctatgtaatagaagctagaaactttttttgaaatggtataaaatattaaagatataaaaaaaatcagcactacgagtgttgtggttacatcccattaggtgaatcaatcttctttggttgcttgttgactcagatgttcgacacatgaatgcttctgaggcccggcaacatcacccaaatacccaaggattgaattctttgaagaaacaaggatcagtttagttcgcctatatatcctgctcattagagctgccttggcttcctcctcctcttccagtcttgattgcattttcacttgcccttcttccaactgcaaaaagaccatgaacaagttatacaacactagaaaccaactacagccatatattaatccccaaaagctaataaagtatatatgtctttaagcatgcagttaactgaacataacatatttgacctttagctgtagatggactttaccaaatagttcaacttgagaagttgatgtttcaaagtcaaaagtaagtgttcaatttgcaaaacaagatgacacgacatgttgaggcttatagtaaagcattttgtttgctgaatgtatattatgaatcatatcgatgaatctgctcttctctcatgttattttggaatgttcatataagatcgaattgtgatgccgagcgtgttttcgcatttaataatcacatcatcttaatagataaattaatttgtcactagtaactctcaaatatttaatttcatattgttggtttaatttttcttctttgtttatctcaaacgtttgagtttcatgtttgatgatatttttaaatattataggacaaatttgatagtggtgacataaatagtcaaagagataatgtcttgaaacatatgagaaggttatggaacaattggagaggatcactgcactcgattgtgaagtctaagccattgcgcgacgttctaaaggttgtgccagagggtgtcgacaagagtgattgggaatggttggtcaaggagcacttcttatctgaaaagtttaaggtatggcttcataaatatttatagcatcttaatttttaagcggcagaccacaccttctattttcttctgttgttataggaaagaagtatgagaaactcagtgaataggtctaagttgattatgcctcatcgtacgggcagcaagcctatcagagagattatttacgagctggtaagtaaattgtgctattgtattaagaaaccccctctttgtttaaaagaagtgtttgacttgtttatttaaatgcgaagggaggcaaaaatggtaatccaccagatatggcgactattttctttgagactcataagaaggacgataagcttgtcgaacctgaaaccaatgaaaaatatgtatgttgattgataaatttcattttacacccttccttttatcaaagtattacattatttcaaagattatacttttttaggctgaaattcaagaactggtacaatctgagccgtctcttacaaatattgaggttgtagaaaggtgctttggacctcaatgcaagagcaatgttgttggatttgggggtggaataaccgctaaagagttaaaaggtggtaattcctctaaggctgccctgttggatgagctgaatgcaactcgaaaagaaaatctatcactaaaaatacgcctggataacttggagaatacagttgcacaacttgcaagaacatactctggtcagccttcatcgacaccatcttcaactgaaccagatacaggcatctgaaaggttagtaaacttttaccaacttgttacaattatcacatgtcatattcatttatttatccaccttgtcactttctattgtcatgtctttctttaagcaaattatagttccactatgatatgatgagtatttcttaatcaaatgaataagcagaactttcttctatttttcatgtcaacaactcaggaaaaagatgacgtaaatttcatgaattagcatgtttgatatttttatctcatagcattatgtgtgctgataccaaaaaagattcttgatcaaaggaaagtccctggattaactggagaaaatgtcgccaaccatttgcagctttacttgtgaatacatatatttaactataattggtatcatggctttcacatattgaataggtgaagttatgtttgatttctgtattacttggtttgcactagtccatgtaggtgaagtaatgtttgacttctgtattacttggtttgaactgatttataatttcagaaaataggagagcacagatttcagtattttcttttacttcaattattaagatattcatgactatctatatggacaccaaccgtccattagttttgatcattggaacctcactttctttgattcttatattgtgataatgtaacacccttttacaccagtcataccaatcgcttcttattacggtacattacattttttttgttcagttaccatcagttaattttaaagttggaaaactttttacagtacattagctcttatcatttgtaaagttcattaacaatagtgattattagtctatgttgctcgtgtgatgatatgaatgtcattaatgttagaatactatacgaactcttatgaataagaagatataaacattagtaaaaaatatgaaaacaagagaggtcatcacccgaaattaacttgatggtgaacagatttgcataaatgaacaaaaatatgaaactcagcctcttatttggttagtatatctttttcgctttcttgggttttctctctatctgttcttgtcatgctcattcactttttgcacagttatgccctatgcttatacatttagtattattagctttttctttcaccatgtttgaaactttttaataaaggttatttgtattctagaaaaatttgtgtgttatgctttagatttataatagccatgtttgatttatttactctaattgtttaattaacacaatgattaaatttattcatttatttttttaaaataaaatagttagagaagtttttactaaactaacatgagcttgttcttttaacagataaaaattttgaagtatgaggatgtcattgaagaaagtacaaagcaagttgatgcatattagatcgtatagctctcttggcggttgtgtagggatgttgtcattgtacatatgttataatttcgttttctgtcctttaggatttgatagtaagaaagtcgtacggtttaaatatttaaatgtgtatatattctagtaatgtgttgttttatggagtagtactttctaattgacagattaattttatgtgaatacatgtggttatttattattttttctgatgtttatgtatatgtatacggaacaataaatattattgcaaagacatggaaaaatttatgaattatctaattgcatttattaaaatttcatttaagtgaagaaaaatatggtctttacaactatttaatgattggattgccaaattgttaaacatgtattagcggaaaaaaattagtcgttaaaaatattatcgttaaaagtaatagaaaattaacgaaaggaaactccagtcgctaaaagtgattatagtaatcgaatttgtggttgtttttaaagagctttaacgaccggatgacaaatcaacgacgggaaaattcggtcacaaaagagtaagtataacgaccataaaatatttcgtcgctaaagaatctttaatgaccgaactccaatccggtcgttaacttttaacgacggcgcatttagtgaccggtgacgaccagtttttgcccggtcgttagtgacctatagcgaccatatttgggcttttaacgactggattttttgtcgctaataatcacttctcttgtagtgacccgatccggagatatataatcctcacaaccaggtgtcacaaccccagtccaccctccgtgaacatgtcatgacggcacctagtccctacgactaggtaagcctaacattgcggaaataaaataatttgcggaaaataaagaaaaccaaattaaatatctagaaggaaaatttgtattgaatgtcgctcggcatatacaactccacatcacaagtctaaaacaaaatcccaaaacccgaaaactcacgggcaacataggctagaagagtacaataaggtgctctaaatatccagaagcgtctacatcaaagaacgacagaaaactaaactctacaagatagaataagagggagactcttcggtctgcggacgcggcatatatacctcaaagtctccgtagctctccctgatcactgataatgtgcctgagaggagatacctggatctgcacatgaaaaacatgcgcagaagaggcgtgagtacaccacagcggtactcagtaagtgccaagcctaacctcggtcgggtagtgatgagaaaggttagggccctactgagataaaacataataataagaatgtacagtatgaaaacagatagaaataatggaaacaacagctaaataagacagaatatacaagtcaacaataaataaccgaagtaaagaataaacacagaaatgtacagctcaataccaaatatgccatgaggatctcccaggataccgtcttgtagtcctttctcaactgtccattggatctcccgggatgccgccccgtagtccaactatcaatatggagggggatatatcgggaatctaacccgcagtcccaaagtaaatatgcagggggatctatcaggaatcgaacccgcagtcccaaagtaaatgtgtagggggatctattaggaatcgaacccgtagtcccaaagtaaacaaaaaagggggagctaccggaatccacatccgtagtcccaatgtaaatacataccaacaacaagagaataatcagaaatggaattaaatgccaaggcaacaggaattctaacataacatgcttcacgtaaggcaacaaggcaaattaagcaactaaacatgcttttctaggctatcacaggctatatttgaaagtaaacaaagcaagtaagaaaggaatatcaacttgatcatttaaagtaaaaatcgaattttcaacaattagctcaagtacgcgctcgtcacctcacgtacaagacactcaatcatcaaataacaagtcctaagggaaaaggtcccccacacaaagttagacaagccacttacctcgaaccggtacaaaatcaactagaaaccacgcctttgccatgagtatccgactccaaatggcccaaatctattcaattcaattacatatcataaataacatcgcaagcaactgattccactattaaatttgaagctaaggcacgaaaataggtaaaatgaccaaaacgccccttaggacaacgtcttggaatcggataattttcatattttcagaaccctcgtactctcacgagtctaaccatataaaaatttcccaaatcggaggtcaaatacccactcaaaacgcaatagataggtctatgaagttttccccaattttcattcaaaaatccgaaattaaggaagaatttgtgattagattagtgggttttaagcataagggagtagagaatcgttacccactagtttcccttgaaaaaccttcgaaattgttcccaaatctgagctctcaaacttgtattttgataaaaatggctaaacctcattttttgaatgttttaatactgcccagacaattagtgcatcgcgaacgcggagatgagctcgcgttcgcggagaaggagaaatggaagctgccaaaatgcccttcgcgatcgcgaagggaagagtgcgaacgcgaaggcctgggttcatgagctacacgaacacaacttctgtaacgcgaacgcgatgaagggagacgtgaagctccgcgaacgcgagggacttaacgcgaacgcgatgaagagactggtcctcctccaaaattattctacgcgaacgcgtgggggaggatgcgaacacgaagaagggggaagccaaagctacgcgaacgcgatgggtggttcgcgaacgcgaagaagaaagtagaacctgcaactgctgagaatttttctgtaatctttcaaattccaaaatgctccgttgaacacctgaaacacacccgaggcccccgggacctcaaccaaacctacggacacatcccataacatcatttgaacttgtaccaatccttaaaccatctaaaacaacgccggaaactcgaattaattaatgatttgaacctaagaacttcaaatttcaacaaaacacgctttcgataaaaaccctaaccaaaacacgtccgattgacgtgaaattttgtacacacatcccaaatgacatgaaggtgctacagcaactcccgaaattccattccgacccttggatcaaaaactcactgtcggaccggaaactttaaaaattcaaacttcgacattttaagcctaaatgagctacggactttcaaaatgcattccgaacacgctcccaaccctgaaatcacctaacggagctaatggaaccatcagatttccattccgaggtcgtcttcacattgttctgactacggaccactttccaacacttaagctctcatttagggactaagtgtcccaaaacactccgaatcctaacatcgaacgtcccgaaaaaccaaaatagcagaaatgaacttaggggaagcagttaatagtggatcagggcgtaaattataaaaatgaccggccgggtcgtcacatcctcccacacttaaacgttcgttcatcctcgaacgagtatagagaatatacctgaagtagtgaaaagatgagggtatcggctgcgcataacccgctcggtctcctaagtctcctcctcgaccggctgaccccgccactgaaccttcactgaagcaatgttctttgaccttagctttctaacctgtctgtccaatattgccactggctcctcaacataggataggtccttgtccaactggactgagctgaaatccaacacgtgcgacgggtcaccgtgatacctccggagcatcgaaacatgaaataccggatgaaccccggccaaactgggaggtaaggcaagctcataagcaacctccccaactcgcctcaaaatctcaaaagggtcaataaatctcagacttaacttccctttcttcccaaacctcatgacgcctttcataggcgaaaccggaagcagaacccgctcaccaaccatataggaaacatcacgaaccttccagtccgcataactcttctatctggactgggctgtacgaagtctgtcctgaatcaccttaaccttctccaacgcatcctgaaccagatcggtgcccaatattctcgcctcacccggctcaaaccaacccaccggagatctgcacctcctaccatacaaagcctcatatggcgccatctgaatgctggattgatatctattattgtaagcaaactctgccaatggaaagaactaatcccaagaccctccaaactcaatcacgcacgcacggagcatatcctcaagaatctgaatggtgcgctcggactgtccgtccgtccgggggtgaaatgttgtgctcctcgtcacccgagtacccaactcctgctgaacggctctccagaaccgtgatataaactgagtacccctgtttgagatgatagaaactggaataccgtgcagatgaacaatctccctaatgtaaatctccgctaaccgctccgctgaataggtagtacacacaggaatgaagtgcgcggacttggtcagtcgatctacaacaacccaaatggcattgaatttcttcgcagtctgagggagaccaactacaaaatccatggtgatcctctcccatttccactttggaatctctatctactgaagcaacccagccggtctctggtgctcagccttcacctgctaacagttgaggcatctagctacaaacccctctatgtctttcttcatctgcctccaccagtagtgctgtctcaagtcctgatacatcttcgcggcacccagatggatggaataccgcgaactatgagcctttgtcaatatcaactcccgaatatcatcaacattgggtatacagacccgaccctacatccttaataccccgttctcaccgatagtcacatccctggcatcgccatgctgaaccctgtcgttgaggacatgtaaatgggggtcatcatactgccactccctgatacgatcgaacagtgaagaccgagaaaccacacaagctagaacccgactgggctccgaaaggtccaatatctcaaactggctggctaaggcctgaatatccatcgccataggcctctctaacgctgttagatatgccaaactccccaaactctctgcccggcgactcaaggcgtcggctaccatattggccttgtcgggtgatacaaaatagtaatatcataatctttcaaaaactctaaccacctcctctggtgcaaatttagatctttttgcttgaacaagtgctgtaagctccgatgatccgtataaatctcacaaggcacactgtacaaataatgacgccagatcttcaaggcatgaacaatcgcagctaactcaagatcgtggacaggataattcttctcatgtaccttcaactgtctggatgcgtaggcaatcaccctaccgtcctgcatcaataccgctccaaggccaatcctcgaggcatcacaatagatagtataagaacccgatcctgtaggcaatataagaactggggctgttgtcaaagctgtcttgagcttctgaaagctcgtctcgcactcttccgtccactggaacggagcacccttctgggtcagtctagtcataggtgccgagatagaagaaaacccctccacaaatcgacggtaataacctgccaagccaaggaaactgcgaatctctgtcgctgaggatggtctaggccaactctgcactgcctctaccttcttcagatccacccgaataccctcgatcaacaccacgtgacccaagaaggccacataatccaaccaaaactcacactttgaaaacattgcatccaatttcttttccctcaaagcctgaagcactgtcctcaggtgctgctcgtgctcttcctcactccgggaataaacaagaatatcatctatgaaaacaatgacgaacgagtcgagatatggcctgaacacactgtgtatcaaatgcataaaagctgctggggcattggtcagcccaaatgacataactagaaactcgtaatggccataccgagtcctgaaggcagtcttcgggatatctggctcccgaatcttcaactgatggtaacctgagtgcaaatcaatcttagaaaacacctgtgtgcgctgaagctggtcgaatagatcatcaatccgaggcaaagaataatggttcttcactgtaaccttgttcaactgacgataatcaatgcacatacgcatataaccatcctttttcttcacaaataagacaggagcaccccacggtgaaacactgggtcgaataaaaacccttatcaagcaatttctataactgatccttcaactccttcaactcagaaggagccatacggtacggaggaatggaaatgggctgagtgcccggcaacaaatcaataccaaaatcaatgtctctatcgggcggcatgcccggaagatcagctggaaacacatcgggataatcccgtaccactaggactaaatcaacagaaggggtatcaatactgacatctctcacataagctaaatacgcggcacatcccttcccaaccatacgctgagctttaaggaaagagataactctattaggagtgtgatctaaagtaccactccactcaacacgcggaatacccggcatagccagcgtcacggtctttgcgtgacaatcaagaatagaataatggggcgacaaccagtccatgcccaagataatatcaaaaccaaccatgttaagtaataatagatctgctctggtctcgaaaccatgaatagtaactaaacacaaccgataaatgcagtccacaataagagaatctcccacaggagtaaaaacaaaaacaagagaactcaaagaatctcgggctacacccaaatgcggagcaaaataagaagacacataagaataagtggagcttggatcgaatagaaccgatgcatctttgtgacaaaccagtataatacctatgatgacagaattggaggcaacaacctcggtacgagcaggaatggcataatatctggcctggcctccccctcgagggagacctctacctccccgacctccgcccctagctggctgggtagatggggtagcagctggagctgtgatcatggcctgagaactatgcggagcacgctgtggctaaggagtctgagaaggcgcacccctcctaagtctggggtaatcactaaccatgtggcgtgtgtcaccacgcttaaaacaagctctgggagggcgcagtggctgtgactggctggggccaggtctgctggactgacctcgaaaaatagccagcgtaggaggcgcgctagaaaccggaggtgcatagtaaggctcctgctggatgatggaagagctgaatgaacggggcaacccatataacccctaccatgacgacctgctgctggggtacgggtactagagtagtgacccgactctcgagacctcttggcctctctctcctctcactccctggcgagcataccctcgatcctcctggcaatgctcactacctgctgataaggaatgtccatctccaactctcgagccatgctagatctgatgggtggaataagaccctcaatgaaccggcgaaccctctcgcggacagtaggaacgaaagccggtgcatgcctggccaaccaggtataacagatagcatactctgaaacggtcatagcactctggcgcaaattctcaaactctgctatgtgctacttagtgtcggtgtataggcatggtgacggttatctatgcacctgagtctagcatgaccgtgagtccttacttgttctaattgaattatatcttccgaattccttgaaatgataaacatgattagtaaagtgtacaatcgagtataagtgacaatttgtgtggtttgggagcattggctcgacttggcttgattgattgatgaactatgaagtggaagtagatgtgatcatatcccttgcagggatctttaatggaatttatattctttccccgttatgaattaattggattcttatgatttagcgagggagagtgattatgcacgacgggtccttccgtgccatgttattgaaatgattatgcacgacgggtccttccgtgccatgttattgaaatgattatgcacgacgggtccttccgttccatgttattgaaatgattaagcacgacgggtcttaccgtgccatgatatgagagtgtgagaggatgagaagcacgatgggtgttgccgtgtatggtttgaatattgttgtaaggtttgaaagtaaaggcaattgatttgtatcgtaaacgacctccttgatttctctgcttaacttgtagctccgtattacgtccttcctgattagttttggtttgttgaactatttttcccccttatcatgtcccctcccgataaattgtttaattcttattttaattactgctagcatgtatagaactgtattattgcacaagttgatttgaaagtaggtcctgtctagcctcgtcactacctcgtgagccggggttaggccaggcacttaccagcacatggggtcggttgtgctgatactacacttctgtgccctttttgtgcacagatctgggagcagccttcggagcgcagcagcagccgtagttcgggagctaaccttcagtccggagacttcaggtagcttgctggcgtccgcgagtcctggatctcctctagcttagttgatgttggttccattgtcttcggaatagacttttgtttatttcttcagacatctggttatagtaactcttagtagttcgtgagactgtgacacaaatcttgggtagaggttgttattatgttcttccgcacttcgcttgtttttaattaaattgagacttcctctttatttctattttaattatatgtctatttgaataaaaagggtgttaattgcatgttaagttggcttgcctagctccgacagtaggcgccatcacgactcccgatggtgggaaatccgggtcgtgacaagttggtatcagagcactaggttacttgagtctcacagctcacggacaaactcggtagagtctgagggatcggtacggagacgtctgtacttgttccccagaagctacagagttaggaaaagtcccactttgttcattcttgtcgtgcgattctgtttctcaatattgattgtctttctactatgttccttcgctagatggcgagaactcgagcttcctcttcttctgatcagcagccctctgccccagcagtagctccagctaggggcagagggcgaggccgcgctagaggccgtggtgagggcagagctcagccccgagcagcagcaccagtggcggagccccagattgatgttgaggaggttcccgccctagctgtgcctatggttattccgggtcttcaggaggccctagctcagattatgtcggcttgctctggactagctcaggtagtctcagccaccgctgcagcagcaacttcacagacagggggaggcaatcagacccccgtcgctagcacacccgagccagtagcgcagggattacagactccagaggcaccgccagtgcagcagattgccccagttcagcctgcggtgccagttcctccaattgtgccggttcagccagctgtgccagttccgtcagttgtgccagctcagcccataacagtagcctagccagttgttgcgggccagtctagtgatggtgcggctatgtccgcggattttttatggagacttgaccgctttaccaggcttttcactcatactttcagtggtacgccttctgaggatgctcagaactttaaattcagctgtcatgaggtcttgaggaccatgggtatactagagaccaatggggtcgattttgccacttttcgcctggccggatccgccaagacttggtggggggatttctgtctatctagaccagcagggtcgccagcgcttacttgggatcagtttgcggagttgtttctggggatgtttctccccgttactcagagggatgctcttcgtcgtcagtttgagcgtcttcagtagggatctatgactgttactcagtatgagacgcgatttgtggatcttgcccgtcatgctattttgatacttcccactgagggcgagagagttaggagatttgtggatgggttgactccggagatccgagtgcagatggctatgagtgccagtagtgatctctcgtttcaggacgcggcggatggtgctcgccggattgagatggcactgtccttaggtggtggtttcgggtctgataagaggctccgtcattctggtcgattcagtggtacctcttttggaggtagaggttcatatggtaggggccagccccagaggccttatcagtcagctcttcaggcctctcatggtgctccaggtagtagcagttctcagcattattattctagacaacagcctattagtgccccgccactccagagtttccggggaggacattcaggccgacaggttcagcagccgagggtttgtcatggttgtggcgatctaggccacattattagattttgtccttatgcttcgagtagatcccagcagcagggaccccgtcccatgattcatgcaccacccaccccacagtctgcccagccagctagaggcgggggtagaggtcatagaggtggaggcagaggtcttagaggtggagctcagctagcgagaggtaggggtcagacagccgcagatcagcctagaggtgctattcagggaggtggggccagccccgttgctatgctttgccagccagaccagaggctgaggcgtccgatgcagtgatcacaggtactattctggtttgtgatagagatgcttcagtattatttgatcctggatccacgtattcgtatgtgtcgtcatattttgcaccttatttggttatgcctagtgaggctttgggtattcctgttcatgtatccaatccagtgggggattctatagtagtggatcgggttcatcgctcgtgtgttatggtgctcaggggtcttgagacccatgtcgacttattattgttggatatggtggatttcgacgtcattctagggatagattggttgtctcctgatcatgcgatcctggattgtcatgccaagaccgtgaccttagcgttgccggatatgccccgattagagtggagagggacccccggtcgtaccactcgtagtgttatttcttatgtgaaggctcgacgcatggtcgagaaggggtgtctagcttatctggcttatgtccgcgactccagcgctgaggtcccgtctatttattccgttcctattgtttgagagttccctgaagcttttcctttggatttgccaggcatgccgcccgacagggacatcgatttctgtattgatttggcgccgggcactcagcccatttctatccctccttatcgcatggcgccaccagagttgaaagagttgaaagaccagcttcaggatttgcttgagaagggtttcattagacccagtgtgtcgccttggggtgctccagttctatttgtgaagaagaaggatggttctatgagaatgtgcattgattaccggtagttgaataaggtaacgattaagaacaagtatctactaccgaggatcgatgatttatttgatcagcttcagggttcgaaggtattttcaaagatagatttgagatctagttatcatcagctgaggattagggcgtctgatgtcactaagactgcctttcgtactcggtatgggcactacgagtttttggtcatgtcgtttggattgactaatgccccagcagcattcatggagttgatgaatagagtattcaggccgtgtctggatttgtttgtgattgtctttgttgacgacattcttatatactcccgcagttaggaggagcatgagcagcacctcagagtggttcttcagactctgaaggatagtcagttgtatgctaagttctcgaagtgcgagttttggttgagttcggtcgcattcttgggtcatgtcgtgtcggtagcaggtattcaggtggacccgaagaagatagaggcagtcaagaactggcctcgaccagcttcagctatagagattcggagcttcttggggttagctggttattacagacggttcgtagaggggttttcatccatagcatcccctatgaccagattgacccagaagggtgccttattcaggtggtcgaacgagtgtgagacagcattgaccacggcaccggtattagtgttgcatacaggttcaggaccgtacacggtctattgtgatgcttcccgtatcggactgggcgcagtattgatgcaggatggtaaggttatagcctatgcttcgaggcagttgaagatccacgagaagaattatccagttcatgaccttgagttggcagctattgttcatgccttaatgatttggaggcattacttatatggtgtgacgtgtgaggtttacatcgatcacaagagtcttcaatatctgttcaagcagaaggagttaaatatgaggcagagaagatggttagagttgctgaaagattatgatgttactattctatatcatccggggaaggccaatgtggtggccgatgcattgagtaggaagtcggctagcatgggtagtcttgctttcattccagtgggtcagagatcgcttgccttggatgttcaggccttggccaatcgtttggttagattggatgtttctgagcccagcagggttttggcttgtacggttgcccgctcttctctatttgagcgtattcgggagcttcagtttcatgatcaccattttatgtgtcctgagagacacggttcagcgaggaggtgccaagaaagtgactttgggaagtgatggtgtgttgaggttgtaggggcgagtttgtgtgcccaatgtccatggtattcgagagttgatcttagcggaggcccacagttctcagtattctattcacccgggcgccgcgaagatgtatcaggatttgaaacagcattattggtggcgtagaatgaagaaggatatagtagcttatgtcgctcggtgtttgaattgtcagcaggttaagtatgagcatcagagacctggtgggctatttcagaggattgagcttcccgagtggaagtgggagaggattaccatggattttgttactggtcttccgatgactcggaggcagtgtgattcagtttgggttattatggataggctgactaagtcagcacacttcatcccggttgctaccacctattcatcccagagattagccgagattaatatcagagagatcgtccgccttcatggggtgcccatatctatcattttggatcgaggtccgcagtttacttcgcatttctggagagccttgcagggagagttggtcactaaggttcagatgagcacaacctttcatccccagacggagggtcagtccgagaggacggttcagattcttgaggatatgcttcgagcctgtgtgattgactttggaggctcatgggaccagtttttgccattagcagagtttgccaacaacaatagctaccagtccagcatccagatggctccatatgaggcgttgtatggtaggcggtgtaggtcccaagtcggatggtttgagccgggagaggctcggttattgggtacggatatggttcaagaggccttggataaggtcaagatcattcaggatagactccgtacagctcattctagacagaagagttatgcagaccgcaaggtcagagatgttgctttcatggttggggagcgagtattgctccgtgtgtcgcctatgaaaggcatgatgaggtttgggaagaagggcaagcttagccctaggttcatcggtccgttcgagattctggagcgagtgggagaagtggcctacagacttgctttgccacccagtttatcagctgtgcatccagtgttccatgtgtctatgcttcggaagtatcacggcgatccatcgcacgtattagatttcagcactgtccaattggacaagggtctgtcatatgaggaggagccggtagctattctagaccggcaggttcgacagttgaggtcgaagggtttttcttcagtgcgtgttcagtggagaggtcagcctcctgaggctttgacctgggagtccgagtccgatatgcgtagccgttatccccatctgtttcccgactcaggtacttctttcttttgtccgttcgaggatgaacggttgtttagaggtggagattgtgacgacccaaaggggtcatcaccgtaattctcccttgctccgtgcttctgaggcctcgaaaacctcttgaggggttacctcgatttgcgtgcgcagtccgggcgcgaagccggaaaggttttatattatgaaagtggaattatgtgtttaaaatgtggaattctaagtataatattggtagggttgacttcggtcaatattttgagcaaacgggcccggactcgtggtccgtcaatttctgaaaatccgtagtaaaatattggacttgggcgtatgcccggaatcgaattccgaggtcccaggcccgagttatgaatttttctgtgaaaattgtttctgaaattaattaaggaaaataaaaataaaaattgatttgaaaactatcgtatcgggctcgtattttggttccgacgcccggtacaggtcctatatgttgtttaagtgctatctgtagagtttcatgtgaatcggacgtcgtttgacgtgtttcggacttgaatatagaaatcttgagtttcatgtgttaaagagaggaattgtgattttggggtttaatccatagattatgatgttattttggcgatttgatcgcacgagtaagtccgtagggtgtttttgaggtagtgtgcatgtttggtttggagccccgagggctcgggagtgttttggataggtgtcggatgcatttttgcatggttggaattgcagcagatgcctcagacctacaggcttcgcatttgcgaagccttgttcgcaattgcgaaatggtccatttccagcccaatctcgcaaatgcgagattgactttgcatttgcaaagtcccccctttctcttccagccttcgcaattgcgaggtgcatgtcgcaaatgcgacttccctattccccctgcccttttcgcaaatgcgaaatataagtcgcaattgcgacttccctctttcccctgtccatttcgcaaatgcgaaatctaaatcgcaaatgcgacttttcctcacttcttcctccatttcgcatttgcgaatttaacttcgcatttgcgaagtctgcatctgtgtaaaaattacttaaacgattttttaagttcattttcattatttcaaaacccaaaaccctcttggcgattttctctcaactctttcttctccaattcgattgtaactccatttttacttgttttcttcaatcatcatcatcatctaacatgatttcatcttaaatcaaagattttcatgggttaaaaatggaggtttgggtagaaactagggtttttcatattttgagcttttggacctcgatttgaggtccgattttaattccaattatagatatgagcttatgagggaatgggtaacccgattttggtccgaacctcgagtttcgaccacgtgggaccgggggcattttgggaatttttgggtaaaactttaggaaactcattcttatgcattcaaattagtttaattagcatttgttaattcatttgggtaatttatgattagatatcgttgtttgggagtcggattctagaggaaaggcggtgttagaggcttgattgctagttcggcattgaggtaagtgtttgatctaaccttggcttgagggaataggattagggtgttgcttgctatgtgctacttggtgtcggtgtataggcatggtgacggttatctatgcacctgagtctagcatgaccgtgagtccttacttgttctaattgaattatatcttccgaattccttgaaatgataaacatgattagtaaagtgtacaatcgagtataagtgacaatttgtgtggtttgggagcattggctcgacttggcttgattgattgatgaactatgaagtggaagtagatgcgatcatatcccttgcagggatctttaatggcatttatattctttccccgttatgaattaattggattcttatgatttagcgagggagagtgattatgcacgacgggtccttccgtgccatgttattgaaatgattatgcacgacgggtccttccgtgccatgttattgaaatgattaagcacgacgggtcttaccgtgccatgatatgagagtgtgagaggatgagaagcacgatgggtgttgccgtgtatggtttgaatattgttgtaaggtttgaaagtaaaggcaattgatttgtatcgtaaacgacctccttgatttctctgcttaacttgtagttccgtattacgtccttcctgattagttttggtctgttgaactatttttcccccttatcatgtcccctcccgataaattgtttaattcttgttttaattactgctagcatgtatagaactgtattattgcataggttgatttgaaagtaggtcatgtctagcctcgtcactacctcgtgagccggggttaggccaggcacttaccagcacatggggtcggttgtgctgatactacacttctgtgccctttttgtgcacagatccgggagcagccttcggagcgcagcagtagccgtagttcgggagctaaccttcagtccggagacttcaggtagcttgctggcgtccgcgagtcctggatctcctctagcttagttgatgttggttccattgtcttcggaacagacttttgtatatttcttcagacttctggttgtagtaactcttaatagttcgtgagactgtgacacaaatcttgggtagaggttgttattatgttcttccgcacttcgcttgttttaaattaaattgagacttccgctttatttctattttaattatgtctatttgaataaaaagggtgttaattgcatgttaagtaggcttgcctagctccgacagtaggcgccatcacgactcccgatggtgggaaatccgggtcgtgacaggactcaactggccttgttccatgtagcagatgtattcattgtcaatgtttcttttttgttgcagaaactgaaagaaaccaacatagccaatcgccaaaagttgagatatccacacactgctggtaaaaaaagttttgctagaatatgcgaggtttgatatgttttttcttattattcttttaaatatgaacttgctaggcataatctgaactattttatatcactttttatgtaaccaggaaaaaaagaaagaaacttctgaacctctatcaagtaaggatatatttgtggctaccagaaaaagaaagcccgatcgagtatacaaggcctcgtatgcggatactcttaataaaattgtacgagttactaatttaaagtttgttgatatcatttgtctgttattagttattgactcaattttatatactttctcatctaaaattgactcaatttggtcttgtaggctgagatggataggatacaatcaacacaagaaactgaagatggcagtcaaccagttgacgcgtttgcgtccgtcatgggacctgagcatccaggacgcctaagattgtacggacgtggggttaccaagacttccttaaaaagaaaaatgggagatattggaacctcttcaagttctaccgatgagatgctgcaacaaaaaatggtggaaatggaagaaaggatggaacaaagaatgcagaaaaagttcaatgcacaaaaagatgccatggaactacaagttgcagttaacattatttcaaaacttaagcgtctgaatccagacttacgggttgatcccagcatgctagctttcaatgctcattcacctggagatgtttcctcggcacaacaagctgctgtgcaactaatcaatcgtctatttgctgggagtaataatcgaggtcagtacatactcttcttctcctcctcctcctccttggctagcagaacgttgaatcaaacttgttcctttcggatttcgggcttggctagccaaattctcactgccttgtgcttcttttccactactggagagtggaactatttgcttggccatcatatcctcctttaaagttgttgcttccatttgatcatcatccacaactgccagtgcttcaaaaacatttgggctgggcacaatattagaagcatttcgtcgacaatctgcagaattttgctttggtgataccactgacttagcaggtgattttctagtagaaaccaagttcaaaccatcctcttttttgtttgtactatcacccttatcatctaccttttcatccccagccttgacttccaaggatacatccttattgccaatctctttacctccagtggaaagggcttcatcaccatgactgaccactggtgcgttcaattgcccagtggtattcacattcgttgccccagttacagcttcccttacattcctacattgtaaattaacatcagttcacattaatagcctttgatcctgtatcctgctccatatcacctttcccaccatctgccttagtgtcaatttgcacacttgcggcagctcgatcaaaaccagcaacagttgcattcttagaagcgtgcaacttatcacaacgaacataagccaacttatttagactattttcagcagcttgttctgacatcttttgtacatgcattgcatattgaaattctggactaagaatatgcaggaagcacaagaccccagttaccctaccatcggcatcaatccttttatttgcagatattaaggcttcaatgtatttaccctgcttatcagatattcactaaggactgctgcttttatttgttttcttcttctgctagccacatgaattgttgattagtaacgttgttttgaactcgatgtcttctgaatgctaggttgttgtccatgttatggtgatactatctctatgtattattccatcctttaccatgattgtaactgaaattaacatagccagaaagttttaaatggataacatattagaatatcagaagttccagtgtattaggtgataaaatgactagttggcaactcgacacatgacagaattcttttgctggcttgatgattggttggttacacacaattgtcggtttgtaatcgtatttgagctaactttgtttccagcggctaatgtgtttatcttgtttatgcttctgcataaaaaatgaatgcttgtttggttctgttttactaaattgttaagcttgaatggattcccgcttgagctagaagaataaatcgttcgtaggaagttggcaggtcacttcttaagagtggttcttatgagttttgcttgtttctggttgcgtcttagttgatgtactttcacttaaaatccagattgttgttttccaaatgtccatgatattatttcaatatgtttaagatgctggagtgtggtgaatgctatgtgaatatgctcagagatgaagtgtaggttcgaaagttttaagttcatattggtgtgtttgctggtgtgttaattttgagggactaaactcagtgttactatacccattcttatttaacgactttatttattctcttttataggtggagcaaccgaagaaagggaagatggagaaggtggagcaactgaagaaagggaagatggagatagtgaagatatagaccttacttaagaagaactttgagttgttgtcgatattcttagagtcttttgttatatcatttgaaactttaacttttgaagtgttgaactataaaacttatgtaattgggttaaaacattttgctattatcgttattcttagcttattggatatgaaagattatgaagtgttttatctttttatttatataatttccaggttataattacaaatatttccaggtggtaatgtcaattaaacgtttaaaatagcctaatagaaccgttgcaataagcacaaatgtcgttgccatagacattctgacgttccgataggtcttgcaaaccgttccataaagtgtgacaaattgatgcaatagaaacaaaaccgttacggtagcgcaataaaaccgttacaatagctataaacaaacgttgcaatagcctacataaccgttgcaatacactatattgtaacagtttccaaccattgtagtaaataatatggtaacggtttacaaccgttgcataaactatacggtaacggtttttacccgttgctgttgaaacgaatattcgttgcttcgggaaaaccgttgcgatagctggatctatagcaacggtgttttcaaccgttgccaaaaccgttgatgtagatctattggcacgcgagcggatctcatggtcgctgaaccgttccaatacctctatggcaacggtttgcctatcaattgcaacagtttaccaaccgttgccatgggcctatattccagtagtgtttgctctacaaatactccctccgtttcaatttatgtgaactcatttgactgggcgcggagtttaagaaaagagaaaagacttatgaacttgtggtgtaaaacgaagcacatgtatttatatggccgtaaatcattgcataaaaataaattatttccaaataggaaaatggatcattctttttggcacgaactaaatagaaaataagttcacataattaaattgaaacggagggagtaagttttccctacaaaactgtatagaaaaacctgcatgtatgatcttcgcttgttgtatcccgaagaagattgtccgcgttttcctcaattagaatacaggcaatgtcattctcacgcttcaagcttttgttgttctcgttttcacattactaaattatctaacaaatgatatatagtgttaaacgtagaacaactaattacaagtaaaatcatgcaaatcataagccaatcacgaattgagtatttgtcccagagaatttaacatggggttcaaatcttgtaataattccttctttttaaaatgaaaagaatattttattggtagtttgagcagtaatgaatggcggttgggtagtggggctaagatgactttgtcaagtctactaataaatgatcgtttacacattaattttccactgcatttttaacagtcaactgataagccaacgtttatgctttaattttgtattggtaaaatttggattctgtacgtggcactgcaaaacaacaatacgtgtcggatttcgaagtcatgagtactccaaagcagatgagctgagaccgaaactaccgttctgctctggttttagattcaacaaattcgtgggcgaatggcacaaatagccactaaaagcagtggcttttattttaaagccactgttttcaatgtatttagactttagtcactcctttaataaacttatacccgaccggacgaaaatacccttatgctcatgtctttaacttcaggacttcaggactacatatccttaacttttgaacttgaaactataagttaaggacttgaaattcaaagttaaggcccgacaggacttgaaattcaaagttaaggaccgacagtcctaatgttttaaacatgggattataacttaaggacttgaaattcaaagttaaggaccgtctgtcctaatgttttgaacatgggattataacttaaggacttgaaattcaaagttaaggaccgtctgtcctaatgttttgaacatgagattataacttaaggacttgaaattaaaagttaaggaccgacgcataacttaaggacttgaaattcaaagttaaggaccgtctgtcctaatgttttgaacatgagattataacttaaggacttgaaattcaaagttaaggaccgacgcgaaagagaagaagaaagggtaaaattgtcttttctctattagcagtggctattttcgctgagcattataattagtggataaaaattaaagacaccgttaattagtggctactacacgccatttttaccaaattcgtcggccagcaaccacacgtacatgggccgtggactgaagcagtgtcacgtgcaggggcggcccaagaaaattgatggcctaaagccaatttttaatttggggtctttcagaagaaaaaaaaattcgtctatatttttaatagaaatctatttttctatctttttaagatgtaaagttgttaatagtttcttttaaaaataatttaatctctcctaagatactgttgatcttagataataaaaccggattcaagaagtttataacttgatatcgaaataattcttgatgttctaatatacttgttcaaatgcttgaaacctgaggggggaaaaggggggaaaaaaaaagaatgcgcaacatagttttattcaacggtacttttaaactatttttttatagaaaaaataaaactctttttctcctatagagaacaatataactgtgacgacccgacccgtcgtctcttgtatttcagccctgttatccccgttatatgtcttcccgtgtgttggtatgcgtgtttggtgagtttgaagtggtttgggttagaattggttagatataagtcaaatagtctctttaaggaaagcttaagttggaaaagtcaacccgacgttgacttatgggttaaagggctcggaatggatttccgatggttcgactagtttcgggggttgattgtgacttaggagtgaaaacggaagtgaattcggaggtccggagtgaaagttagcttagtttggcgaagttggaatttcagagaaatccggttgataggtgagaatttgatccgagggtcggaatggaattccgaaagtggcaatagtttcgttaggtgaatttgggtatgtgtgtgaattttcaggtcatttcgacgtcgtgtggttggtttcggcatcggatatgagtttgttaagcttaagttaacttagagtggaattctatgatttgtggtgatttttggtgttaatgtgggtgttttcagggctcgagcaagtttgaatgaggtatttggtcataattgtgtttttggtttggaccccgggggcctcggggtgatatcggatggttaaacgaagagattttggagttgtgcatgaagcaggcctgctgcttctggtatttccgcagaagcggaaaagggaccgccaaagcggtgtccgcataagcggataaggaccgcagaagcggtcaaggaggagcccagggatcgtaggagcggtcaggaggaccgcgtaagcggtgaagcgaccgcagaagcggccgctgaggaaatgaagaagaccgcagaagcggtaatttggtcgcctaagcggtgaccgctgaagcggaaaagggccgcttaagcggaaaagggccgcttaagcggaagtcgcccagattttaaaaagaaacagtgggttaaaatattaaaaaggaagaagaacaagagggtttcggacttggcgatttaggggcgattctggagagaatatcaagggaattcatcaggtatgatctaatagacttctaatatgtgattatggtgctaaattatggactaaacacctagaaatcaaggtctttgaagctaaaaatgggggttagggcttgaaacccaattggactttaattgaggaattgaggggtcatatggactccgattttgataaaatttatatgtatggactcgtggcgagacgagggtcgttttggtataaagttttcgggttttcgagacgtgggcccggggttcgggttttgctagtttcgagattttggttatttctcggttgtttttgattgggtattgtcccatttgcatattgtgatgtattcgctctgtttttgcttagattctacgcgcgaggaggccgaattgagaggcaaaggcgtcgcgagcttgagatttcgccggttcgaggtgagtaatgggtgtagatgattacctgagggttcgaaaccccggtatatcacattatgacgctattacgaggctggacacgcactccatggttagtgcggggtcgtatgtgttgtgaattgtgactcggtccaatccgacggataaattgtgctatgttagcgattgcttcacaccctatattgtcggcatctggacttgatgctatgtttggggccttgtgccgacttgtagaatccttcagggatatatatataagtgtgatatattggcgattgcttcgcactctatattgttgatatctgggcttgatgccatgtttggggccttgtgccgatctgtagaatccttcagggatatatatatgttgcatcatcatgttatgcatcctatttgaacacagtccaaaggttttaaactctgatttgcaaaactcaaccacagttacacattttggaaacttaaatgcttttaaatgacattcttggttgatgaacattgttttactatatttctgtactgtgcatgactcatggaacggtagtaacgattggcaccgtggatttggaaaggaaatagtggtaacatctgacactgtgagatatatatattgatatagcgcttgggctgtaggagcccctccggagtctgaacccccacagtgagcgcgggtacccatatggatggctcgggctgcacgccgcagtgttcatgcatcgcattacatcgcattcatactttattatctgttgctttgcatggttacttcttgtactggagatgtataggattgttggtgtttagctttgctgtgtgctatatctggatttcctgctttcgggtttttatatacatttattactcactgagttggtagactcaccctatactccctgcaccttgtgtgcagatccaggtgctccagaggcttagcatgtgctgctgctgattatcagatagacagagttttgaggtagctgccagcgtccgcaggacccatttctctgctctccttgtcattttgttcccagtcgtctagactttcgtattatctcctgttcagacttgtattccgtattagtagaggctcggtactcgtgaccctcaattttggggaacattggggaatcttctatttctttcatattgtcttggctctaactgggcggtttgatatataagctgtgatttgaatatgtaaatctcttcttgttgggctgtaatgccatatgttgggttgttgtggtcgggcccccctagccttgcggtcgggcgccatcgcgaccgggatttgggtcgtgacaacttggtatctgagcctaggttgctaggcctcacgagttatgagccgatttagtagagtcttgtggatcggtatgtagacgtccgtatcatatccacgggaggctacagaactttaggaaaacacttcactttcttggaattcttatcgtgcgtacttgattcagcttgggatatgactcttgaaattccttcctcacgtttgtatgcgcccgtgagcgcccagtattatatgtgccctgatggctgatgattccccgatcgaggggcgagtgatgattttcagtgagttgatgttgagctagtctggaggacttgaggccgaatctttgtctatggctggagcaccaaggtgcggattgcgcgagctagtgttatgagcttataagttcagtatcgtccctaattgtggtgatggcggctggatagcttcatgatgagtacgttggttgttgtgtgatgtgtttgtatgacttggtaatgtcgaagaaggtctgctaggtgataagcgaactagtgagtgtttgatttccattgtgatcagatgggttgccccgagttatgggcgcgtgaagaatcttttcgagtctcctagctgggagtgaggtagattgcatgatgcggtatgagtccagactcaggaagactaagtgattgcgtgaggtgtatgacggtggatgatgtactgaaatattatagtgaagcaagcaggtgggtatctcctatagattatttgaagtggtatgaccattatgtgtaagttagaagatcttatgtgtaattaaaaggtatttcctatatgttatgattcgaacaggtgcaacgcatgttcatgtgtcaattttgggtaatataatacgtgtagcattgggatttctgttattgatatacattgtggtgtcttgtcaagttgtggacgtgttgttagactggttttggtggttctctggcaggtggataggctcagttacaaaggaaactctgctgaaattttgaaaaaatttggggacatagtaggaattttgtcgcccaaagagtggacttaaaggttgtgtgaatgaatgcaaaaattggagaaaagttagaatttctgatgatccgtgtttcctcaagcttatgtaagattgagtttaatcttgccctggtattacgatagcaatagagtatatatgttgtgatgtatacgacttcgagctaagttggggaggttgcgggtgatgagctggttgtacggttatgtactatgttagttccgatttgatgcgtgtgggtgaatcagttctggttgcagaaagtgagccgagggtggcacaagtgaagcaaaaattttgccaaaggttatatggtgcttcgtataggtgggacaatgagagaatgtcttgagttgatgataagaaatgcttagtgttaagggaatgaagttgtttggttatatcgggatgagatcatgccctgtggtgtcagagtgctgataaggcacgagtggttcgattcattaagtcaagtgatttgtagtgtttataagagtggatgacaattgagaatggtttttgatgtgatcgagatttgatatgtatcactcaggtgttctaatgttgagtgtgtgaccaagtcagtgttttcattagaacaggtcaagacttgtggtatttctatgttaattacgggattctaggtatcagtatttggaaagtaagggtagctaattcagagtcgcggaattctttgggtaaagtatgttggaatgtggtaattctgagcacgtttgaggaagtattcagtggcctatgcgtcttagacagtgtggcctggtgttgggtctcgtatagtgagtcggggttgaggcattgtggtgctacagcaagagagtatatccagttgaaagtgaatcaggtaaaaatctagacaaataaagtaacttgtgagtggaccgaatcggtatggtaaagatatgattagtcggttgtatgtgttcgaggtaatgggttcttacaagcgttgggcggcgaagctcctgagtactggaggtcttcttagcttggttcaggtagagggattccgtccttggcagtttaatctgtgcaaatagaattgggagagaattcttgttgagtttcatcatggtttggagatgtatattctctacggtcatgcggagcatgaagtgtatgataatttttcttctaaatgggatcaatgcaagttctggactagttaagtgcgtcgatggttgcggcacagaagggagatagaaattctcgtgttatccttggaaggtatggtgtatgcggtatgttgtaaaggaccgagatgggtgtgtgcgagggttcagtttagttctgaaaggtatggtggatttggctatgtcttagataatgagtagcctcaggtaatcaaggaattggtactgttaattggaagtgagttgacgagggcatatgtttcggaaagagggtaattccacaaaaaatacatcagtagtgttacggcatttttcttatgggatcgactgcggatatctgagttgtttgatggcacatgggagttttagaatatctttcgtggaataaatggacacttgaggtgtaatctgtattcgtattatggcaattgggatcagttgcagtaatgcgtgtgctatggttagttggggattgggagttctccggtgcagtctatgtaatggttatggatcgagtgtgttgtattggttctgttagcagctattgggacttggaagccgagtgaatctttccttgcttagtatattaaatcctggttatggtattgggatacagagtgattgtctcaatgtggttattctagacgatggtgctatgggccatgttggaagatgccacaggttgcgtggcggagggtatcggactatgttctagctgaatgattgtgttccaaaggctagcggacagctgggaaggattgcgtttccttaattgggccttcgaggcggatgtcagtatagaggtttctaccattgatttcggttccagtattgagggactcttcagatgcgttcttgtggccgggcatgtcgccgggcgagactgtgatttcagaaattattctgtgccgggcaccatatcgtacggctccggtatgagttatagtagtggaagtggaatttgtagcttgcagcgcttaaatgaatatctatatgcactcagttgcttcgaccgatgttggtattttgttattatgagcaaaatcggctcgatgtgcacctccctatgtgaggtatgttgtgtggatagggtggcacgccgccacgagtatgttatttggatcgggttgcgcaccgcaacagtgtgataatgagcatagctttccatgtgttgttttgtattcctcgtttcctggcttctgaggaaagatccgtattgagaattgcttgatgaatagcgtattggttgtgtccttccaggaccgaatggtgtatattacttgttttaccgtgagtgtgatgggtggttttggtttcagacatcgatctgtgcatggctgtctactttgagcatggtaacacgagatgattcatgtgtaacagagttgagattgggatcgcgcgttgtggcgaggccacgtggaattatgaactctcgaggaggattcaggtactctattactacgatatgagacgaggtctcagctttgttttgtgaaggtaattgatgagcttgaggtatagctcttccgattgagtcattgcccggagtttgggaatgtgtagactgttcttgttggcgcgtgtattatgcaattgtggcttaggcctgtattgaggtatcacatcaccatgagtggtgtgttaggttcgaggtgatcattggggtcattaagtaatatgaacagatttgggttcagctggttagaaagagaatatcgaggtttggcttgggaatctgttgtggtaatagtcagcatgaaagtgacttcatgcatagttgatctgaagaactgctacagctcattgcgtgttttagttatcattggcagcatacgaaagtgttggaataagactctagctaaataagaggttatctattggaattgagtattatgggcaactgctatgaataaagactatcattccgagtgtggaaatgtgtggaatattgcatgaattcacttgaggtttgcaggtgtgaattattacagctggttcggattaattctaagtatatatgtggggttatgatcatgtgtatgatttcgggaagtgcagtgtggttctacggttatgggccaggtggattgtgaaacttcagctgtgtggtgtattcggtacctatgtaagttagggtgacatgggatcaccccgggtatatgcctggcaatgtcatttggctattgggttgcttctagtacagctctgggtaagctcgaggacgagcgtttgtttaagttggggaggatgtgatgacccgacccgtcgtctcttgtatttcagccccgttatccccgttatatatctccccgtgtgttggtatgcgtgtttggtgagtttgaagtggtttgggttggaattggttagatataagtcaaatagtctctttaaggaaagcttaagttggaaaagtcaacccgacgttgacttatgggttaaagggctcggaacggatttccgatagttcgactagtttcgggggttgattgtgacttaggagtgaaaacggatgtgaattcggaggtccggagtgaaagttagcttagtttggcgaagttggaatttcggagaaatccggttgataggtgagaatttgatccgagggtcggactggaattccgaaagtggcagtagcttcgttaggtgaatttgggtatgtgtgtgaattttcaggtcatttcgacgtcgtgtggttggtttcggcatcggatatgagtttgttaagcttaagttaacttagagtggaattctatgatttgtggtaatttttggtgttaatgcgggtgttttcagggctcgagcaagtttgaatgaggtatttggtcataattgtgtttttggtttggaccccgggggcctcggggtgatatcggatggttaaacgaagagattttggagttgtgcatgaagcaggcctgctgcttctggtattttcgcagaagcggaaaagggaccgcctaagcggtgtccgcataagcggataaggaccgcaaaagcggtcaaggaggagcccagggatcgcaggagcggtcaagcgaccgcagaagcggccgctgaggaaatgaagaagaccgcagaagcggtaatttggtcgcctaagcggtgaccgctgaagcggaaaagggccgcttaagcagaagtcgtccagattttaaaaagaaacagtgggttaaaatattaaaaaggaagaagaacaagagggtttcagacttggcgatttaggggcgattctggagagaatatcaagggaattcatcaggtatgatctaatagacttctaatatgtgattatggtgctaaattatggactaaacacctagaaatcaaggtctttgaagctaaaaatgggggttagggcttgaaaccaattggactttaattgaggaattgaggggtcatatggactccgattttgatgaaatttatatgtatggactcgtggcgagacgagggtcattttggtataaagttttctagttttcgagacgtgggcccagggttcgggttttgctagtttcgagattttggttatttctcggttgtttttgattgggtattgtcccatttgcatattgtgatgtattcactctgtttttgcttagattcgacgtgcgaggaggccgaattgagaggcaaaggcgtcgcgagcttgagattttgccggttcgaggtgagtaatgggtgtagatgattacctgagggttcgaaaccccggtacatcacattgtgacgctattatgaggctggacacgcactccatggttagtgcggggtcgtatgtgttgtgaattttgactcggtccaattcgagggataaattgtgctatgttagcgattgtttcgcaccctatattgtcggcatctgggcttgatgctatgtttggggccttgtgccgacttgtagaatccttcagggatatatatataattgtgatatgttggcgattgcttcacactctatattgttgatatctgggcttgattccatgtttggggccttgtgccgatctgtagaatccttcagggatatatatatgttgcatcatcatgttatgcatcctatttgaacacagtccaaaggttttaaactctgatttgcaaaactcagccacagttacacattttggaaacttaaatgcttttaaatgacattcttggctgatgaacattgttttactatatttctggattgtgcatgactcatggaacggtggtaacgattggcaccgtggatttggaaaggaaatagtggtaacatcttacactgtgagatatatatattgatatagcgcttgggctgtaggagcccctccggagtctgaacccccacagtgagcgcgggtacccatacggatggctcgggctgcacgccgcagtgttcatgcatcgcattacatcgcattcatactttattatttgttgctttgcatggttacttcttgtactggagatgtataggattgttggtgtttagctttgctgtgtgctatatctggattttctgctttcgggtttttatatacatttattactcactgagttggtagactcaccccatactccctgcaccttgtgtgcagatccaggtgctccagagggttagcgtgtgttgctgctgattatcagatagacagagttttgaggtagctgccagcgtccgcaggacccatttctctgctctccttgtcattttgttcccagtcttctagactttcatattatctcctgttcagacttgtattccgtattagtagaggctcggtactcgtgacccttgattttggggaacattggggaatcttctgtttctttcatattgtcttggccctaactgggcggtttgatatataagctgtgatttgaatatgtaaatctcttcttgttgggctgtaatgccatatgttgggttgttgtgatcgggcttgcctagccttgcggccgggcgccatcgcgaccggaatttgggtcgtgacaataacttatcgagaacttaagcttttttgtagaaaccaagaagaaaatataagaatgtagtacccgttttctgatgagaaagataaaaaataagacttgaactattgaagataccaaaaatggattcagaaagtttattacacgtttttagtgagaaatgtaaaaggggaataataatataggtgcctcactaatgatgtcaatcataaaatttaaataatgaaaagttttatattcgcgacaagggtttagggggagtgattctctttctccaatttttgcttaaacggttacatcaatactaaattaaaggttatatttactttttataaaatattttatttttttattttaacatacctaatatatttagaccctatctctaaagattgttgtgagatatatatgatccaacttaccttatattgggttcgagtcctatggttaaaataaatcctgttaaaatatattctctcttttactaggccttatgcggtacgaatctagattagtcgggagctcaatacaaatacgagtagaaaacaaaaaaataaatttggggccctctaaatttgggggcctaaagcctttgctttagtggcttgacccttgggccgcccctggtcacgtgacactacttcgtcggaatttttttgaaacatatgtattaatactctaaagggaataacaagaaatgaaaatgacaccacttaactcaaatggtctgctctggttttagattcaacaaattcgtcggccagcaaccgtacaggggccgtggattgaagcagtgtcacgtgacactgcttcgtcggaattttttttgaaacatatgtattaatactctaaagggaataacaagaaacgaaaatgacaccacttaactcaaatggtcgcctagtacattgattaatgtctaattttgctctaggagctagaggttcgagccttgctgtcatgttttttggtttatttaagagcctgtattgttaaaaattataattgagtttaattaaactccctcttcaatgttttaagactcaaaagaactaatggtctaaggctatcttttgtctagaaatttcattattaatattatttactctccatcttttataaatatcgacagtaggggtgtacaaaggaaaccaacaaactgcaccaatccgataatccgagtcaaaccgagaaaaaaacctgactatggtttggtttgatttggttcggtgttggaacaaaaaacccgaccataattggtttgttttggttttaactaaagaaagtcaaatcgaaaccaaaccaacctgacattatatatatagaaatataagatatatttaatatataaatatatttattgtgatgtaatttatagatatatcttaaaagttttcataattttattttttaaggtattattttaaggttggacctagaacttttgactgctccaataagttttataatcattgtcacgacccggattttccaccatcgggagtcgtgatggcaagttggtatcagagcactaggttacttgggtctcacaactcacggacaaactcggtagagtctgagggatcggtacggagacgtttgtatttatcccccagaggctacagagttaggaaaatctcactttgttcattcttgtcgtgcgattctgtctctcaagtattgattatctttctactctgttctttcgcagatggcgagaacacgtgcttcctcttctaccgcgcagcagcctgagcccccagcagcatcatctattaggggcagagggcgaggccgaggccggggcagagctcagccccgaggagcagtcccagaggtggagcctcatgttgactacaatggaggaggttccagctccagcagctccagtgggcccagctcgggtcccagagggttttatagctacttcagtgcttcagtacgctttgttccgactggtaggattcatggaggggatttctatatcgggtttgcttcccgtagctccagccacatctcaggctgggggaggagttcagacacccactactcatactccagagccggtagctcctcaggctcaggtaccagcagtgcagccagttgtggtagttcagccagctgtggcagctcaaccaattgcggctcagtccagtgatggtgcggctatgtccgcggatgctttgtggaggcttgatcgcttcaccaggctctttactctcacatatagtggtactcctttagaggatgctcaaaaattcatattcagctgtcatgaggttcttcggaccatgggtatattggagaccaatggggtcgatttcgccacttttcgcctagcaagatctgcgaagacttggtggagagatttctgtttagccaggccagcagggttgccatcattgacatgggatcagttttcgaagctatttctgggaaagtttctcccagttacgcagcgggatgcccttcgccgtcagtttgagcgtcttcatcagggtactatgaccgtcactcagtacgagacccggttcatcgatcttgctcgccatgctatggtgatacttcccaccgacagcgagagggtgcggaggtttattgatgggttggctcagccgatccgtgttcagatggctctgagtgccggtagtgagatctcatttcaagaggcggcagatgctggccacaatagagattgcacttgctcagggaggtggtcatgggtctgataagaggccccatcattctgggagattcagtggtacctcgtctggaggtagggattcctatggtaggggccatcctccgaggccctttcagtcagctcttcaagcctctcatggtactccaggcagcggtggtggttctcggccgtattattctgaccaacagtctttcggtgcatcaccagctcccattagtgcaccgccacttcagagtttccggggtgatcattcaggtcggcagggtcagtctcagcttcctcagttgcagcattcagacgggtgttatgagtgtggagaccttagtaacatcaggaggtattgcccgagattgagaggtgctcggtcacagcagcagggaccccgtcctatgatacgggcaccagctgccccacagcttgcccagctagctagaggcgagggtaggggacatagaggtggaggcaaaggtcatagaggtggagctcagaccgctgaaggtaggggtcagcaagtggccgatcgttccagagatgtgatccaggaaagtggggcccagccccgttgttatgctttgccagctaggccagaggctgagttgtcagatgctatgattacagctactattttggtctgtgatagggatgcatctgtgctatttgatcttggatctacatattcgtatgtgtcgtcctattttgcaccccatttggttatgcctagtgaagccttgggtattcctgtatatgtgtctacgcccatgggtgattctatagtggtggatcgggtgcatcgatcctgtgttgtggtattcatgggtcttgagacccgtgttgacttgttgctcttggatatggtggatttcgacctcatattagggatggattggttgtccccgtatcatgcgatcttggattgccatgccatgaccgtgaccttggcgttgccagatttgccccgactagagtggagagggaccccaggtcataccactcgcagcgttatttcttatgtgaaggctcgacgcatggtcgagaaggggtgtctagcttatctggcttatgttcgcgactccagcattgaggtcccgtctattgattctgttcctattgttcgggagctccctgaggtttttccttcagacctgccgggcatgccgcccgacagggatatcgatttctgtattgatccggcaccgggcactcagcctatttccattccgccgtatcgtatggcaccgccagagttgaaggagttaaaggatcagcttcaggatttgcttgagaagggttttattagacccagtgtttcgccttgggcgcaccggtgctatttgtgaagaaaaaggatggtacgatgaggatgtgcattgattaccggcaattgaataaggtgacgattaagaacaagtatccactgccgaggatcgatgatttattcgaccagcttcaaggtgtgaaggtgttttcaaagatagatttgagatctggctaccatcatctgaggattagggcgtctgatgtccctaagacagcatttcgtactcggtatgggcactacgagtttttggtcatgtcgtttggattgactaatgccccagcagcattcatggagttgatgaaccgagtatcaggccgtatttggacttgtgcgtgatagtctttattgacgatattcttatatactcccgtagtcaggaggagcatgagcaacacctcagagtggttcttcagactctgaaggatagtcagttgtatgctatgttctcaaagtgcgagttttggttgagttcggtcgcattcttgggtcatgtcgtatcaacagcaggtattcaggtagacccgaagaagatagaggcagtcaagaactggcctcgaccagcttcagttacagagattcggagcttcttagggctagcaggttactaccgacggttcgtggaggggttttcatccattgcagcccctatgactagattgacccagaagggtgcccagttcaggtggtcggacgagtgtgaggcgagctttcaaaagctcaagacagctctgactacggcaccggttttggtcttgcccacaggttcagggccatatatggtctattgtgatgcttcccgtattgggcttggtgcagtattgatgcaggatggcaaagtcattgcctatgcttcgaggcagttgaagatccacgagaagaattatccggttcaagatcttgagttagcagccattgttcatgccttgaagatttggaggcattacttatacggtgtgacgtgtgaggtttacactgatcacaagagtcttcagtatctgttcaagcagaaagagttaaatttgaggcagaggaggtggttagagttactgaaggattatgatgttactatcctatatcacccgggaaaggccaatgtagtggctgatgcattgagtaggaagtctgccagcatgggtagtcttgcttatattccagttagttagagatcgcttgctttggatgttcaggccttggccaatcatcttgtgaggttggatatttctgagcctagtagggtgttagcttgcacggttgctcgatcttcgttattggagcgtattcgtgagcagcagtttgaggatccccatttgtgtgccctgagagacacggtgcagcgcggaggtgccaagaaagtaactttgggagatgatggtgtattgagattgtaggggcgagtctgtgtgcccaatgtctatggtattcgagagttgatcttagcagaggctcatacttctcgatattctattcacccgggcgccgcgaagatgtatcaggatctgaagcagcactattggtggcgtaggatgacgaagaatatagtagcatatgttgctcgatgtttgaactgtcaacaggttatgtatgagcatcagagacccggtggtttattccagaggattaagcttcccgagtggaagtgggagaggattaccatggattttgttactagccttccgatgactcggaagaagtttgatgcagtttgggttattgtggatagactgaccaagtcagcgcattttattcctgttgcagccacctattcatccaagagattagctgagatttatatcagagagatcgttcgccttcatgaggtgcccatatctatcatttcagaccgaggtccgcagtttacttcgcatttctggagagcggttcagggagagttgggcacccaggttcagctgagtacagcatttcatccccagacggatggtcagtccgagaggactattcagattcttgaggacatgctccgagcctgtgttattgattttggaggctcatgggaccaattttttccattagcggagtttgcccacaacaacagctaccagtccagtattcagatggctcctgttggcccaagtttcagttggagttttgaagattgacaaatgaactgatggaaggacctggtccatcttgtactacacagtctgaatcaaccattgcacataagaagcacgtgaggaagatatgcactaaagatcacgcatcaatatcttctgaacataatcgaaaaggttgcatttgggataaggaggagagtcttcttatatgaagagaacttaatcctaagttaggataagagttggagtttgcattggctaaggactcgaattgtgtacgaatgagaagtggagtcttaatcaaactctaactactaactcaatatataattgtgttggttctcttttacaggtaacacacacaagcagaagtaaagcatatttgagagaaaatagagcaagtctgatttgcaagcaatatatgcaagatacaagtgtgtacgcctacagctatatgaactaagagagaagaaccagttccatctgagtgtttatttctagttcaattgtagtaggtttttatattgtacctttcagcttatttagaagcaattgtattaggtaccttgtgtaatcaagttagagttaacttgatagtgtcgcagcagttgaggctgtgtgccacactgggattagagtttaatccttaggtttacaaagagtttttgtaaatgctgtttggctcttgattttagtggaagtttgggaaaatcctactgagtagtaggtcgtggttttttcaccttctgatccaggtgtttttcacgtaaaaatccttgtgttatttatttctgctattttaattacgcaaacaatagctagtagaacacctagaagaaccgggttcttctagatcgaaaaattaggtaccacacaaatcacccccctcttgtgtggtattgacgtttatttacatcaattggtatcagagcgtgttatccttgaagaggttaacaccttaggaaaagatcataatgagtgcaccacctgggaattgggaaggacagtctactgccaggcctccactattcaatggtctctactactcttggtggaagaacagaatgagggaccatatcatgggtgaagattatgagcgttgggacatcatcactgatggtcctcttgctacaaccaagaagaatgctgaaggagtggatgttccaaagactagagctgattgtactgctgaagatctaaagaagtgggagaaaaatgctaaagccaagaaatggttagtgtgtggacttggtcctgatgagtacagtaggatttaaagctgcactactgccaaagaaatttgggacactctacaagtggctcatgaaggaacacctcaggtaaagaggtcaagaggaacactactctactctcaatatgagaatttcactatgaaggacggagaaactatccaagagatgtacactaggttcactactctgacaaatgaacttgagtctcttggaaggactatcctggaagaggacaaggtggagaagacctgactagagtcctaccaatcacatgggaaagcaagatcacagctattcaggaatccaaaaatactgccacattaaaattggatgaactgattggaaatctcactacctatgaattgagaaggcagactatgaagatggatgctccaaagaaggaaagaagtctggctctcaggatctcaaaaggatcagatctcgaagatgatgaaatgggtatgataaccagggatttcaagaagtatcttatgagaggaaagggtccttcaagaggaacaacattcaacaaacctagggctcccgagaagcagacaaatgattgttgctttaagtgtggaaagacagatcacatgatcaaaaactgcccccaatgggagattgagtggaagaaagaaagggcagacagaaggaccaggaggaaggaataggttcaacctagaaggaacagaggaacgaccaaagctatggttgctgcatggggagaaacgtcagatgaagattcagaaattgaagctgaagatgagcaagctcttatggccatcggagaatcagaagatgaacaggaggtaagtattcttcatcttaaagaaaagataaaattcctgtctaaagaaaagttggctgagctcttgatagacttcatagatgagtatgaaattataaacagtaagaaaaatgttctgtctagggattgtgtaatactagaagaaaaatacaaaaggttagagtccagggctgatgaaagtgataacacaaatactgagttgaagaaccaggttcttcaactggaaaacagtgtcctggaacttaggtctaaaaatttaaaactgaaaatagggacaggtaagaaaaaggttgatcaatcatttctcacactagaagaaaatctaggaaaaatgaaagatgagttgtataagaaagatgaatcaatcaaagtcctaaaacaataactagtaaaggtgaagcatgaactagacagaacatgcaaatggaacaaggcttctgatgcactctcctggctgcaagaacatcacagcagcaacaaaagaggacttgggtttgggacacaagctccaaaatgggatcccaaaaacaagtacctcactcttcctgagaataagatctgtacacattgtggtaagactggccattacaaaaatgaatgcaatgcaaaagaaaaggccagtcaaaagaacaaagcttttgttcaagaaaaacacaaactgcctggttgggcaaagaaaagtttaattcgtccgtttgcccatagaaagggacccaaactagtttgggttcctaagactaacccctgattttattttgcaggtccaagtgaaaggaagtagccaaatatggtacatggatagtggctgctcaaaacatatgactggtaacaaggaccagtttctttcacttgagaacctataaggaggtaatgtctcctttggaaatggaaagaaaggtgagatcattggggttggaaaggtaggaaagacagattctcactccattgagaatgtctacttgatagatggcttgaaatatagtctgataagtgtgtcacaattatgtgacagaggtaaccttgtagctttcacctctaccaaatgctttgtgattaaccttactactgacaagattattttgcagggaaaaagagttaacaatatctacattgtagatttgtcaactctctctgaaaatgaactcacttgcttaagtgtgttaattaatgatcccctcctttggcacaaaagacttggtcatgccagtctaaatcaattgaacaaactagtcttcaaggacttggtgataggtttagctaatatcaagttcaaggaagacaaagtctgtgaggcatgtgcaagggggaagcaggtaaagtcatccttcaaaacaaagaaaatggtaagtacgtccaagacgttggaactggttcatatggatctctgtggtccaatgagatcaatgagcagaggtggaaaaagatatgtaatggtgcttgttgatgacttctctagatttacctgggttctatttctaacctctaaagatgaagcatttgaaatgttcactgcttttgttagaaaaatccagaaacaattaggaaatcaacttgcatccattaggtctgatcatggaactgaatttgaaaatgcaaagtttgctgaattttgtgatgaaaatggaatagatcataacttctctgcccctaggacccctcagcaaaatggggtagttgaaagaaagaacaagacccttgaagatatggcaaggaccatgttactttccagtaaactacctcatagcttctgggcagaggcaataaatacagcatgctatataataaacagatatatgaccagaccactggtagagaaaactttctatgagttacttaaagggagaaaaccaaacatatcccatctaagggcctttggttgcaagtgttatgtgcacaataatggcaaagactcccttggtaagtttgatcccaaaagtgatgagggagtgttcttgggatattcttcacatagcaaaccttataaagtgtttaataaaagaactctatgtgtagaagaaagtgtacatgttgtttttgatgaaactaacactctttctgagagacaggaacatgaagatgaagccattggactggtgagataacagacagaagccactactcaggtcaaggtggcatcaaaggaaggaataggtgatggaacaggtccttctacccagggcaatcagacagggggaactaatgtgagaagtactgaacaaaaggaatctgttcttgaacctgttcctcagtagcaagataatgatgaaacatccagcaggaaccagttaattggaaaatcttacaagtaccttagctctcatcccattgagaacattctaaatgatccaacatctggagtcaagactagatcacaactgaagaatctgtgtgcatttgatgcctttctgtctcttattgaacctaaaaatgttggtgaagcactacaagatgcagattgggtcaatgctatgcaagatgagctgaatcagtttgaaagaagtcaagtctggcacttagttcctaggcccaaggacagatcagtcattaggacaaaatgggtcttcaggaacaaacttgatgaagatggaactattacaagaaataaggcaaggttggtggttcaaggctacagtcaagaggaaggcattgactatgatgagacatttgctccagtttctagacttgaagcaattagactcctcataacctttgcagcacatatggaattcactcttcatcagatggatgtgaaaagtgccttccttaatggctatctcaaagaagaagtgtttgtgaaacaaccaccaggatttgaaagcaaagaatgccctgaacatgtgtacaaactagataaggctctatatggtctcaagcaggcaccaagagcctggtatgagaggttgtccaaattcctattggaacatggctacgaacgaggtaaaattgacagcacattttttctaagggaaaaaggtaaagatcttcttgttgtacaaatctatgtcaatgacataatttttggggctacaacagataggttaagtgaagactttgcaaaattaatggacagtgaatttgaaatgagtatgatgggggaactaaatttcttcttaggcttacaaatcaaacaaagtccaaatggtactatgattcatcagcagaagtatacaaaagaactaatcaagaaatttaaaatggaagaatccaaagaaatagatactcctattgcaactgccacaaagttagatgctgatgaacctggttcatcagttgatcaaaagttgtacaggggtatgattggttcacttttgtatcttactaccagcagacctgacattgttttcagtgtaggactttgtgctcgtttccaagcaaatccaaaggagtcacatctgacagcagtcaaaagaatattgagatacctaaaaggaacaactgatatgtgtttatggtatcccaaaggtagtaattttgacttaattggatatgctgatgctgactatgcaggttcctagtggataggaaaagcacctcaggtatggcacatttcttgggctcatgtcttgtatcatgggctaccaaaaagcagaattctatggctctctctactgctgaagctgagtatgttgctgttgcttcatgttgtgctcagttgttgtggatcaagcaacaattggtagactttggaattgaagtgggatgcataccaatattttgtgatgacactagtgcaattatgacaaagaaccctgttcatcataaaaggactaagcacatagatgttagacaccacttcttaagagacaactatgaaaagggattaatctccatagaattctgtgccactgataaacaaatagctgacatcttcaccaaggcactaagtagagaaaactttgaaaggaacaggttggaattagggatgattaagatcacctaagaggtccagttcagaatgcacaatgaaaaataaaaaaattgtcctgtatggttaggagttcttaatatttgtgaatattagactaatttctactcagcataatacttttaaataagtatactcctgtgacatgtagttatataattcactaatctcttacaaattttctattctgacatttgaggcataatcaagagaagtgtcacatgaagaacctggttcatcaatatgtgctcatgaggaaggtcaggtatgtttctatagtttgcacaattagaaaaaaatttaattttcaatcatgagcaagagtcctagaaattccaatcgtctcaaaattctatctgttggaagccaattgaaccagtttcattgaaattagaattctaagcataacggaactcttctcctaaaccttagcaattctaattaatcctaattaattcctagggagaccggaactctaaatcgataagacgtctactgacacctgaaaaactgccttttctggaacaataattacccctctttaaaagcctctctaatcatatcacaaccatcattcatctctaaacctctgatcatttgctcccgtctccaaaccctcaaaaacaaaattctccaaaaatcataagctctccataaatccatcgccatgataaatcctcaagataatcccggaaccccacctcctgtgtcaccaaactccactccatctgcctcacctcccatagaaaccccaaaaccaagattttgtaggcagaaaatgctggctagaaagactgtagctactggctctcttaggaaggccttaaacgagaaattacagtccagccaaagggcacaagtctcagctaaggagaccaattctacctctgactccgatgatttcatctctgccagcgaaggagatgaacctgggtcgtctgacactactacacatcaagaaacccctaaagaggtaaatacttgctttgttcctgttgatatagtacaaaaggtagaaagtaggtatgttctgataggggctgttaaagatgtatctgggactgattctgcaaaatcgatgaagaaaaggaggaagaaggtgttatctatttgtggaagtggggaaaagggggtctcaaagtcagggggaagtggatcaggagaggctgctgaagggttggttgatctgagcaaacaacctgctgaacctagtccatctgtggaagaaaccttggctgacatgatgaagaaggttggggatagttatgatcccaagaaacgcaaggcttcctcacaaaggacccctgttgcgtccaaaccaactaagaaatccaaacctgtatcacccaaggctgctcctagggttagaacaacaagaagcaaggttagagagagtgaagctgagttgaaaaatgaattagaggagagtaagagaaagagaaaagaaaaggggaaagggaaagttggtgagagttcagaagctgtggctgaggaggaggaagaggtgatggaactggtccatccagagaaacacactactgagaaggctcctattgctaaatctaaggagactaggacttctgctaagaagccctcaaagccagtacctgctgagtcctcccttgccaaaagaacaagatctgcctctaaaggcaaacaagtgaaaatggttgaagaagaagaagagagtgatgaagaagaggaagaagatgaatctgggaatgagcaggatagatatgccaattttggcaaaagaaaaattctgaagggtaggctgctgaaagacctggaggagccaggcatgatgaggcttctaacatcactggaagctcaaggttggaaggacatggtccttcagttgaatgggaaactggccaggaaagaacttgttgagttcatggccaatggatcagtgaataatggtcaggtgaccagtacaatgaagggtgtcaaggtgaagttcaatgctgaaaagctgggggagattctggatatcccttgtgaggggtatgatgattacacaaggcagaggtggccttgcttggatgggttgccttcagagctacaaataacaagaaacttctgtgacaccaagacagatgcagaagtgcctgaggccagggcagtgcagaagagtgagatgaggcctgagcacaaggtgctctttgagtttgtcaacaaatgcctcctgcctagacaggaaagaaggcatacagctaactatatggatctagtgctcatgcagtgtatgaatgaatggaagcagatcaactggcctgtgtttatggtgaagctgcttgaaagggtgctaaatggttcaaaggctcatgccattccctatggctttatattgacaactgtgcttgaacgactagatgttcccttgaaaaagtgggaaatggcctccagcaaggagcactttggcatcaagacccttcaagcctgtgactatctgctcagtactggccctgttgaacctggttcatctgctaagactcctgtgaacagcaaagtcaggtccttggttcaggaggttgggatgaaggatgctgaaatagcaaggcttaatgccagggtggctgaattggatggagaaaggaatgggctgagagctgaacttgccaaagaaatggagaaaaatgaaggcatgctccagcaaatgctaaacctgctgcaagcccaaccctctagcacttccaagccttaggtgtcctgtcctcagtgtccaatctagtttccctttcagtgtcaagtttaggaagttcttggtctcttcttgtttgttttgctcatggttggatattttgtttttctttttgtggactgcattgtagaaacacctctttaatcaatgaatgcagcttttcttgctcttgttaatcttgtttttaatagtttattctgagttgatttttgattaacttgtacatgtgttcacttgcagttgccccaacggccatgagtattaattaacttcgaggattcacattatttatgcaacttttcgatgatgccaaaagggggaagatattgtgtttaaaattcattatctgaactagtgatgtttatgacctaaatctgacctccttgatgataagttaaactattttctaagtattgatttcagctaagttcccaggttccctgatcacaatagtattaattaacttcgaggattcacattatttatgcaacttttcgatgatgccaaaagggggaagatattgtgcttaaaattcattatctgaactagtgatgtttatgacctaaatctgacctccttgatgataagttaaactattttctaagtattgatttcagctaagttcccaggttccctgatcacaataagctcagaagttggagttttgaagattgacaaatgaactgatggaaggacctggtccatcttgtactacacagtctgaatcaaccattgcacatgagaagcacgtgaggaagatatgcactaaagatcacgcattaatatcttctgaacataatcgaaaaggttgaatttgggataaggaggacaatctccttatgtgaagagaacttaatcctatgttatgataagagttggagtttgcattggctaaggactcgaattgtgtacgaatgagaagtggagtcttaatcaaactctaactactaactcaatatataattgtgttggttctcttttacaggtaacacacacaagcagaagtaaagcatatttgagagcaaatagagcaagtctgatttgcaagcaatatatgcaagatacaagtgtgtacgcctacagctacatgaactaagagagaagaaccagttccatctgagtgtttatttctagttcaattgtagtaggtttttatattgtacctttcagcttatttagaagcaattgtattaggtaccttgtgtaatcaagttagagttaacttgatagtgtcgcagcagttgaggctgtgtgccacactgggattagagtttaatccttaagtttacaaagagtttttgtaaatgttgtttggctcttgattttagtggaagtttgggaaaatcctactaagtagtaggtcgtgattttttcaccttctgagccaggtgttttccacgtaaaattccttgtgttatttatttctgctattttaattccgcaaataatagctagtagaacacctagaagaaccaggttcttctagatcgaaaaattaggtaccacacaaatcaccccccctcttgtgtggtattgacgtttatttacatcagctccgtatgaggcgttgtatggtaggcggtgtcggtctccagtcggatggtttgagccgggagaggctcgattattgtgtacggatttggttcaggaggccttggataaggtccggattattcaggatagacttcgtacagctcagacctggtagaagagttatgcagaccgcaaggtcagagatgttgctttcatggttggcgagcgagtattgctctgtgtgtcgcctatgaagggcgtgatagattcgggaagaagggaaatcttagccctaggttcatcggtccattcgagattcttgatcgtgtgggagaggtggcttatagacttgccttgcaacctagcttgtcagctgtgcatccagtgtttcatgtatctatgctccggaagtatcacggcgatccatcgcacgtgttagatttcagcacagtctaattggataaggatctgtcatatgaggaggagccagtggctattttagaccggcaggttcgacagttgaggtcgaagagtttccctttgcgtgttcagtctgatatgcggagtcgttatcctcatttatttcccgactcaggtacttctttcttttgaccgttcgaggacgaacggttgttttagaggtggagaatgtgacgacccaaagggtcatcaccgtaattcttccttgtttccagcttctgaggccttgaacacctcgcgtttagttgcctcgatttgcatgcgcagtcagggcgcaaagccggaaagtttttatgctgaaatatgtgaactatgtatctaatttgaagaattttgatattaatattgttaaaattgacttcggtcaatattttgggtaaacggatccagacccgtgatgtgacggtcccgaagggtccgtagaaaaatatggaactcggacgtattcccggaatcgaaatccgaggtcccaagcccgagaaatgaatttttgaaagaaattatttttctggaaaagatatggaattttgaaaagaaaatgagttagaaaatataggtatcgggctcgtattttggttccgacgcccggtacaggtcttagatatgcgttaagcactttttgagaaaattagtcaaaatcggacgtcgtttgacgtgtttcggacctaaatatctaaagttagaagcttctgaacattgaaataaaaaacgatgattttggggtttgattcatcgaatttgatgttattttggcgattctatcgctcgactaagttcgtaggatgttattaagttagtgtgtgtgtttggttgggagccccgagggctcgggagtgttttggagatggttcggggtggtttacacttagaaaaaggcatcagatttttcattgctgttgcggacaaatattgctcttcgcgaacgcagaccctcctcgcgttcgcatagccttctccttccttttcttcgtgttcgcgatacacacttcgcgttcgcgtacaataaaccccagaccccagccatttcctctacgcgttcgcgtaaggaccacgcgttcgcataggcctattgtgaagcccccagattcttcttctacgcgttcgcgtctagcaccacgcgaacgcgatgcctgcccgactttcttcatcgcgaacgtgacctagccccgcgttcgcatagagttattccccttcagtgatttttcttaaaaatagaatgctagttacgggattttctcacttttgcacacgagctcttcactcaacctctccataggcgattttcaagcttctccttcttcatagttctttgggtaagtaatcttaacttcatttcctcttaattccttcatctaattactaagttcctagccctaaatcatgaaatcaaagtagaaatttgggaatttgggtagaactagggcttttgggattttgggcgattcaacctcaattcaaggtcgaatcttgaaacaaattgcatatttgaactcgtggggttatgggtgattgggttttggtccgagcctcgagtttggaccatgtgggcctgaggtcggattttggtatttttggaagaatgataggaaattcatttctaggctatggaattctgtctttgagccattattgatattattgaactaattatgcctagatatcattgtttcggagttggattctagaggaaaggcggtgttagagatttgattgctattttcggaccgaggtaagtgtttgatctaacttggcttgagggaataggattaggatattatttgctacgtgctaagtgtggtgtacggtgtataggcatggtgacggttatctatgcaccggagtctagcatggccatgagtcttaattgcttttaattcgaatgatatgatacggcttcttgtttgaatcgattagttcacatgatatgaacggttgaggataaatagtgatttgtataattctggagcattggctcgacttagaacttgttggcagctaagtgtttaaaggaaaagtactgtgatcattcccttgccggaatttaggtatttattaaattctcccttgccgggatatttgggctgttagttgtattcccttgtcgggactccttgtatgttgttgttactcccatcgcacttgggttgcgattgttgttgggtgagttcttgttgttaaatattgaggatcgggttgcacaccgcaacggtattaaatgtcgaggatcgggttgcacgccgcaacggtgttagatattgaggatcgggttgcgcgccgcaacggagtgtggaccaagtctattgttctcgtatatagagttccctgtttaccttatcagttgttcttgttcagtttcacctcttatctgatgatttctgtatttgaactgtcataccccacatcatgctccccttccttttaattgtttagattagtgtattttcctgttattgcacatatatctgtacaggttatttgtggtaggtcctgtctagcctcatcactacttcgccggggttaggccaggtacttaccagcacatggggtcagttgtgctgatgctacatttctgtgcatttttgtgcacagatcagggagcagcttacggaccgcaacagtagtagattgggagcagagcttcagtccagagacttcgaggtagccttgctgacgtccgcaggcccggagcctctcctatctttattcagtttgttagcttttgtactgaaacagactgttatgctttctttcaaacgattgtagttagtaaaatcttagaagttcgtgagtattgtgacaccaatcttgggtagaggatgttgttaaactttccgcatttcttttggtttattataattgagacttccgcttatatcatcgcttcattttaatttttattatcgaaaatgttagttaaaatatttgaatgttggcttgcctagctcctaatagtaggcgccatcacgactcccgatggtgaaaaatccgggttgtgacaatcattaatattagtaaattaaataacgctaacaaaaatccaaaccaaaatcaaatcaacactaatgctaacaaaagacattcaattcaatagtcaatactacaaacgggaatgtattgaatatctattttgtgttttgcaataatttagatttaaatgcataacctatttttatcttttctttaacgtttagtcatgtaattaatactctcttattagtctacttactttagcatgacttaatacttttagattatgtttatttttattataattttttaattagcaatatttatattgcataattttattgtctttattgttgaatattttaggataatgccatgacacatttcatatgttgtattattttcttggaaaatactttatatagttgtatcttactaggattaaagaaacattttgagcacaaattatttgttttgttctatgaagattttaccggaaaaaaaatccgaaaaccccgaataacccgaaaacccgagaaaacccgaggaaaaccgagattgagaaacccgagttttattggtttggtttggtctttagatttaataatccgacacaattggtttggtttggtaatcgtaaagttcgaaccaacccgacctatgtgcacccctaatcgacagtacttacgaaaatactgcgtacgcccctgaccacgtatgtgccttttagaagagaagacaggagaggcagttgtgtaaataacccatataaaaggggcgattaaataattagtcgaagttaaacacgaggcgggagaagtcagctaggtataaaaaggcgtggctacacgcccaatatcaatcccctacgacctaatatcatctgcttcctttctctcttccaaaatttcatagttttttcaaaagccttcagaaaaggaaaagtccaaattatcaaactgaactccttataatactgtgttaaatatcactgttatatattttacttgtttatactgagtataatattttgatcatgattgtaacggctaataccagagcatttctccccgtcgcaaatcattcacctgaatttagagaaagcgcatcaagaaagctaggaggaagtcttctttttgtagcaaattctaagaagtcttctttttgtagcctacaagttaaggcgaattctcaagcaccgccgcatgtgaatggatcaaaggtctgccttaagcacgatcacaggctcaatatcgacccttttggaccaggaaaactcatggaagatggcttcgtttttcgtcaaagtttcagtatcaggtcatatgaaatcggagctgatagggccgcgtctatagaaacgatgatgaatcttttgcaggtagacataatgttttctgtggttgggaaacattttcggtgaaaggaagaaaataacttctcttgtttatgagcacacaagtcgttttcttataattatcttaacttttaagttcatattacttcgtgagcttgagttggttgtattgcaggaaacatctctaaaccacgccaagattgtaggacttatgggggctggattcgggtcaactccagagatgtccaaaagaaatttgatttgggttgtcacgaagatgcaggttttggtggatcgctatcctacttggtatgtttctattcttgattttaaggttttagtcggtggcggatccaggattttaaagttatgagtgctcgccgataaagacttcaaaagaagagcaaaaataagtttacttgtgggtgctcactcaatatttatctaaatatttgtataattacctatgtaaatttattaaatatggtcatagttaatgggtgcttaagcacccacaagtggccatgtgcatccgccactagttttagttcctccgagaggagctaaagaaaagtattcactcataagcctaagggtgtgatgtagacagcctaccttaatgcaagtatataatggctgctgccacagctcgaacctttaagttggttgaatatggtgattttttttcttattttagattctgcttatatcaagatctgttccttgcatagtaattacacgttttcctttcattgtgaagaaattaatcgcgtagacctgtgatcttgcttcgatttcttttgctcaggggcgatgttgttcaaatagacacttgggttgctgcttcagggaagaattgtatgcggcgtgattcacttgtccgtgatagtaatacaggggatatattgatgagagcttccaggtagatacaattcctccgttccattttatgtgataatgttctccgatttcgagagtcaaacgaatccttctttgaccgcgattcttttatgtcttttaaatactttgaaatattaatcattgtgacttaacttccaaattgcagcttatgggtaatgatgaataaagagacgaggaaattatcaaaaataccagatcaggttaaaactgaaattaaagttaattttgcggatttccctccggttcttgatggggaaaataggaaattaccaaaacttgacgagatcacagcagactatactcgtactggtttaactgtaagtaaaaaaaaaaaaaaaatacttcatgaatgatatagtgtctttctaatgaaattattattaactgttggtttattaaattcatagccaaaatggagtgatctagacgtgaaccaacatgttaataatgtgaagtacattggctggattcttgaggtacatcttcctttttcttataaatttttcccttcaccacattccctttaataatgtcaatgagttatgttgtgtcttatatgagtatgctctttaatcattcataattcacctaatatataaaagttttactaatatcagaagggatattggcgtaactggtaaagttcctgtcatgtgaccaggaggtcacggttcgagccgtggaaacagtctcttgcaaaaatgcaaggtaacgttaaatacaatatagacccttgtggtccgcccttcccataacccttgcatagcgggagcttagtgcaccgggcagccgttactaaagaaaaagtatccatagttcttaggatctcgttgacatatcttttgcgcttatgattatttgggacaatgtattttgttgcagagcgcacctatgcatgagctagagggttatgaacttgttggcatgacgttggagtatcgacgagagtgcagaagggacagtgtgctacaatctctcacgtccgtactgcaaaatgttggtaatttcgccaactccagcaatgtcgagtgtcaacatttgcttcgcttggagagtggcgaagacgttgtgaagggaaggactgaatggaggcaaagatttgtcaacagaactaagagcaatggatcgtgaaatcagctactaatgcttgtattagggtaaactgcctatatcatactttctgtgttaacacgaaatgcgtcgtgcactggactgaccctctaattgagagcaatggataacttaccgcaggaagtgccaagctatctcttgggcatttcacaataccttgttgatcttatattatattttcctttgtatgcttgtttttttcatttattgttcatctctctttcctattggagaaaatagaatttaatgtcataggatgaatgaagattttacgttatagcaattttttagagaaattttcataaagcactatcttttggtagtaattagccatttatagataccatttgttatattacggattatagataccttttgtgtggttataagatgtatttgatgtatttaagctattgtattcatgaatacagtagcaaaaataggcgtgaatcagggaagtccagctaatcagttgttgtattcgagtgtattcgactgtattcatggagtgaaacaagggattacagctggacatattattgtattcaactgtattcgactgtattcacggcgtgaaacaggggattacactgtttttaaaacggaaagtgaatcaattaatataatagactcctaatataactcaacaaacttattataacacataaattttgtattttcagttataaaaaagattctcaaccggaaaataccccaaaaacatagcaatcttcagagaaattatataatacatctgaatacataaattatattaatttaaaaaatatatgaacacattcatggcatataacgagacaacgagtaatgaaatacatataatacagcgggatacattgaaatacaatgaaaaaaaaagacagtgaatacaatgaaatacataaaatacaacgagatacattgaattacaatggaaaaaaagacaatgaatacaatgaaatacatgaaaatacattgaaatatattaacagaaaatcaagttgctcagccctaaactccgtcgtctttgttcaagaacaaaccctaatttccggcgaatccgccgttcaccggaagccggtagtaaaacacgacccaatggagattgtggagagtgtgaggatctgtatggcaaaggctcttgataaggctactactgatggaatccacagggctacatcgtttttcaatgaaatccacatggctacctcgtttttccgtttcttgattttgaaccaaattcgtttggagactgtttttccgtttcttgattttgaacatggctactgatccacatggctactgatcaatgatttcgaacctaaatagagatttagggtgattttgaactttgttttgataatggcggagaaacgtgtgtttgtggagaagatggtaaagcgtatggaataaaagagagagaagctggtcagaggagatatacggtaattaggtgagagaaaatacaaaagggggagagaaaaatattttgtagcatatatggtgccttaattgtaggaacgtgctatatttagatttttttctataaactataaaaggtatttataggatgtaatattttaaaatggtatttatttaatataaatagggtactaatgtattctataggttgtaaaaattccaattttgtactaattataatgcaagatgattattgattctcaaggaacatcctcttgatcttatggacaattcatctatactagtgtttaaattattcaaccaatattttaaatcactaaatcgcattaccggtgcaaaaatcaattgtagatttgccgttcaataattaaaaattacttataattaacagcgtgaagcacggacaatattattagtaatattattataatattgaccatgagctaggaagcgtgaaataattatactattgtgaatgataaatgttacaagaatctgaagattacttccatgatcttcggcagattttctctattcttttcaatatttatttatgaattatttaaggaattatttaaggaattagtttataattacaaagagtgaacattgtggaattaagaaatgcttgataagacaaaagaatgattttgtactcaaagtggctttccatgaaccgtgcactatcaattatatcaggatatctgcctaggatcatggaagtaacctcaaaaaattgtaacaatgatacaatcatttcacccttcatatataatacactcaatctttatatatatatatgtatatatagagagagaaagtaagcgtctcgtggtgcgaccgagtccgggcacaacggggctctcaccctctctggcgcctccttccaggggacttgggcccggtccgctgctgaagatgcttctccagactacaatttggacaacggagctgcccgattctaaggctgggctattcccggtacgctcgccgtactggggaatccttgtaagtttcttttcctccccttattgatatgcttaaacttagcaggtagtcccgccttacctggggtcgcggtcagaccacctaagcgcaagaagggtcagggagccaaaacatgcgacgggttggggccgcgacattacgagagttgattttcaacaaccacttgtcgtgtgtcgccgtggactcgcatttaggccaaccgcatgctcggggcgcacgagaggccagtatctgtcccacgacaccgccacgctcataagtctgggcgcggtgtgtagggtgacgtgatgcgcgacgcctaggcagacgtgcccacggcgtaatgtctttcgatgcaacttgtgttcaaagacttgatggttcacgggattctgtaattcacaccaagtatcacatttcgcaatgttcttcatcaatgcgagagctgagatatctgttgccgagagtcgtttatgtttcaaaagaagcacaagtcccccctcccccgcgcaccgcgaacggggcgcgagaggcaggctttcaatttagtattccttggcgctttccgcgcgggggttcattaatcacctggcactcacgcgagcgcgcgtgctggggataggagggagccccgcagatggaagccgaagcaccccggccgcgccgctccccagtgttaaaacaagttcgtgggtcattctgcttggcaggtattgacaatgatcctcttgcaggtttacctacggaaaccttgttaccacttctccttcctctaaacgataaggttcaatatacttctcgcaacgtcttgggcagcaaacccccatgtcgccacgatccaaatatttcactggatcattcaatcggtaggagcgatgggcggtgtgtataaagggcagggacgtagtcaacgcgagctgatgactcgcacttactaggaattcctcgttgaagacaaataattgcattattctatccccatcacgatgaaatttcaaaatttacccaagcctgtcagccaaggctataaactcgttgaatatattagtgtagcgtgcatgcggcctagaacacctaagggtatcacagacctattattgcctcaaacttctgcggcctaaaaggtcgtagtccctctaagaagctggatgcgaagggatacctccgcatagctagttagcaggctgaggtctcgttctttaatggaattaaccagacaaatcgctccaccaactaagaatgaccatgcaccactacccatacaatcaagaaagagctctcagtctatcaatccttactatgtctaaacctggtatgtttttccgtgttggatcaaattaagtctcaggctccattactcatgtgccgtacgtacacttgcctcgctgatgcatgacaacaatagccccaacatacaatgtgcaaccatgtgttgttgctgatgccaacattgcaaagccaagacaagcccgccaggcacgaacatggggttggagtgtagaaatgaaaaggcgccacaagttaaaggcacaaacacagcccacaacaaccacacgacattcgacatgtaatgagtttagccctacacacacggcaccttgtggcgctgcttgcacgatgcaccactgttccgtttccaaaagccaacagctgccatgagcaatgccagcaccaggcatagcccacaacaaccacacgaccttcaacatgtactaagctcagcctcatgcgcatggcaccttgcggcgctacttgcatgacggttcatcgttccgtttccaaaatccaacagctgccacgagcgatgcaacaacctggcacaactcacaacaaccacacagccttagacatgtactaagattatccccatgcgcacaataccttgcggcaccacttgtacgacacaccaccatttcgtttccaaaagctagcagctaccacgagcgatgccgccattcgatgttgcctacaacaaccgcatggtgttcaacatgtaatgagcttagccccatgcacatggcaccttgcggctccacttgcacgacgctccgccattccgtttccaaaagccaacagctgccacgagcgatgccagacaccacccacaacaattgcacgacattcgacatgtactgagcttatccccattcgccaccagatgttgcccacaacaaccgcacgattttcgacatgtactatgcttatccccatgcgcttgacaggagtagacatgttttggccagagaattataatagacatgtacaacaccaaattgcaaaaactaaagtacaacttagttaataaattcactaattacttttatacattgtaaaatgatattttttaccaataataatatttattatcctgagccaagggtctattgaaaatagcctctctacatctacaaaggtatgggtaaggtctgcgtacacactaccctatctagactccactatgcggaattatactgtgtatattgttgttgtatataacatttattataaaatgaaaaatacataataaaataataaaaaataagaaaaatattataaatatagaaaaaataatggagaaaatttccaatacatctagtaataatataacacataaaaagagtaaatatttttataaaaaaaaaggtaacataaaaactattcaaaattacaaaaaaattcataaaaattaatttacaaaataggtaaaatacataataatattattagtaaaacataaagatgaggaaaaccaataaccatgatgcacctccatcgacacaaccacgataagtgattccaacagccaaccaacaagtatcaaccaaccatcgtcggtcactaccgcacgaaccaccgcaactttccactgccaacaaccacacatcatttctcttgacatgttctaagaattggtatagcactagacatggtgtgacgttgtgcgacatggtacgacatggtgcgacatggtgcaacttggtgcaatgcaatagaacacatgtgagtttgatggggaactatgccagtgcagggcaaagtcagaggaaactctggtggaggcctgcagcgatactgacgtgaaaatcgttcttctgacttgggtaaaggggcgaaagactaatcgaaccgtctagtagttagtttcctccgaagcttccctcaggatagccggagctcgcatgcgagttctatcgggtaaagccaatgattagaggcatcggggccgcaacgctctcgacctattctcaaactataaataggtaggatggtgtggctgctttgttgagccgcaccacgaaatcaagcgctccaaatgggccatttttggcaagcagaactggtgaagtgggatgaaccgaaagtcgggttacggtgccaagatgcatgctaacctagatcccgcaaagggtgttggttgattaagacatcaggacggtggtcatggaagtcgaaatccgctaaggagtgtgtaaaaactcgcctgctgaatcaactagccctgaaaatgggtggctcttaagagcgcgacctacacacggccgtcggggcaagtgtcgggccctaataagtaggagggtgcgacgatcgctacaaaaccttgggcgtgagcctaggcggagcgaccgtcggtgcagatcttagtggtagtagaaaatattcaaatgagaactttgaaggccgaagaggggaaaggttccatgtgaatggaacttgaacatgggttagtcgatcctaaaggtcgggggaaccccgatagatagcgcatttcgcgcgtactccgaaagagaatcgggttaaaattccttaacaaagacgtagaggttgacggcaacgttagaaagtctggagatgtcgggaaggaggggcgggggctagggaagagttatcttttctgtataacaacctgcccaccctggaaacgactcaatcagagatagggtcccacggctcaaagaataccgcacgtcgcatggtgtaggtgctcccccgccgaccgtcgaaaaatttggaggactgagtttcgtccatgcccggtcatactcacaactgcatcaggtctccaaggtgaacaacctctggtcgatgaaacaatgtaggcgaggaaagtcggcaaaatgtatatgtaacgtcgggaaaaggattggctctgagggctgggcatgggggtcctagtcccggacccatcagctgtcagtggactgcttgagctgctcttgcggtgagagcaggttgccacgtgccgaacggaatggtaatggttccttcgggggccttcccccagcgtcgaacagccaactcagaacgggtacagacaaggggaattcgattgtttaattaaaacaaaggattgcgatagtccctgcagatgtttacgcaatgtgatttctgcccagtgctctgaatgtaaatgtgaagaaatttaaccaagcgtgggtaaacggcgggagtaactatgactcttttaagggagccaaatgtctcgtcatctaattagtgacgcgcaagaatgaattaacaatatccccattgtccctgtctactatccagcgaaaccacaaccaagggaacaggcttggcagaatcagcagggaaagactgttgagcttgattgtagtctgactttgtgaaatgacttgagatgtgtagtataagtgggaaccgaaaggcaaaagtggtataccactaattttaatgttattttacttattctggaatcagaagcggggcactgcccctcttttttgacccaaggcttgcttgcaggccgattcggggcagaagacattgtcaaataggaagtttggctggggcggcaaatctgttaaaagatagcgcaggtgtcctaagatgagctcaacgagaatagaaatctcgtatggaacagaagggtaaaagctcgtttgattatgatttccagtacgaatacgaaccgtgaaatcgtgtcctaaagatcctttagaccttcagaattcgaagctagaggtataagaaaagttaccacatgaataactggcttgtggaagccaagcgttcatagcgacgttgctttttgatccttcgatgtcggctcttcctatcattgtgaagcagaattcactaagtgttggattcttcacccactaatagggaacgtgagttgggtttagaccgttatgagacaggttagttttaccctaccgatgacagtgtcacaatattaattcaacctagcacgagaggaaccgttgattctcacaattgcttatcgcgcatgattgaaaagcctgtggcgcgaagctacagtgcgttggattatggttgaatgcctctatgtcagaatctgggctacaagagacgcatgcgcccaccgtccgcttgccgacccgcattaggggcctttggctcccaagggcacgtgtcgttttctaagtcatcactgcggaagagccacagtggctgccttaaagtacaatttccatcgagcggcgggtagaatcctctgcagacgacttaaatacgcgatggggtattgtaagtggtagagtggccttgctgccacgatccactgagattcagtcctttgtcgctccgattcacccctccccctccaacccaatcaatttctaacttttccgaaaagaggtttactccttatttgatgatatattatatgccaagtgctggaaaatagaacaagttcctcaagaccatggaacgtataccatttgtgtattaagtggccgatgtgacttgtcacttagtcatgtcgagggaaaggcttgtgtcacgacccggatttcccgccctcgggagtcgtgatggtgcctactagtgaaagctaggcaagccaaccaactgagctatttaccttgtttccatatttgtaaactttaagaccaaatttcttacactccaatcatttctagaaaggtccgattttcacgtcaacacacgatattagtcccgactggctatagcaacttgtgcctatgcacccatcaaatacggggtattacattctcccccacttagggtcattcgtccttaaatgagaagtagagtccgtcttcaaacacatattgtaacttatctctttctttgcacatctcaatatcccaattttttcagaaattttggcagagtctcccctgtaattgggactatccacctgtcagagtaacaccaaaataactcctaacaacattttcacaactcaacaaatcaccacgatgtatttatcaataacaccaatctccgcattacaagtgtgacactatcataaagatatttcgaccagaaacacatcatatatatgaccttaaccacatctcttgttttaatagtggtacataatcaattacaaaattgccaattaacttcatgttaataaattcttgtttcaagctttcattttactaacaacgtagcatgaagacctcataattacttaaccaaattaacgattcacaattaacgccacctgggcactcaccttgtaggctaaaactcaataattacaatacaatttggcaaattatgcacagagatattcatacaagaattttcaaatagcctcataggcatgtctccctataagtactatattacaaattttaatttcacaaagggagaatttaaatacataaacttttcaccacaaggacctcgtccttatataacatccaccgcagcttgtagcccggtttaaatatttcacataatgtaaaagtacgaggatctcgtcctcaactccgtacacaagtaatatgcacattttgccaactgaaatttttccatttccttttcttcttctagataatttccgttaaacaaaatcacaatatataaagaaccctcatatcgatagggaatataatttacaattgaaatcaattatttggaaattgcatcgaactcaatgaaataattaacaaaaactgcttttagcctcacaactatttttagtgaccaacacataatgatagacatagctatctccatataatctcccaacaggagtattcacataagtaaatttaaggttacgaagctcactcatgagggcagaacatattaggaggacttgcctcgatactcaaaactgaatcaagttaagaaaattattgctttataattattctagaccgtacttgtaacgacacctggtgttgcgacctcagccataccataaaaaatataacaacgggttgggtctccacctcttggagtctcacctccaccactaacatcctgaccgctatctctggttggtcatcacattaaaggaaattatttcaaaataaataaaaatgagaaattgctagtaaattgttgttgggttgcctgacagtggtgtccggtgccatcacgatccatagtggattttggatcgtgacagcttgtctatgacactaaacccagtttcacttctagaggtttttaggggtgtcgcgtgcaatgacaaggcacaagcaaagagtgatatgccaatacaatgtcgcaaatagaggttttttgaggtgtcgcgtgcgatgccaagtcacaaaccaagcgtgatatgccaatacaatgtcgcaaatagaggtttttcgaggcgtcgcgtgcgaggccaaggcctatgtcaatggaccgaggtcggccatggcatgcctatgtcagtggtacgaagtcgggcgtggcaggccaccatggcacgacacagggcctggccatggcacgacgtcgggtgtggcaggggccatggctcgaagcaaggcatggcccatggcacgacgtcgggcgtggcagagcgtggccatggcatagtgcaggacatggtcatggcagaacgtcgggcgtggccatggcacgacgtagggcatggccatggcagaacgtcgggcgtggccatggcacgacgcagggcgtggccatggcccgacgctgaagatgacttggcacatctcataagccaagaaatctatttacttcctccgatccactttaattgattttttggttgttttcgtacgtaataaggaattcatctgttagcattaattaacaataaaattgatcatattaaccttaatttgttcattgaaaatataacaaatactcctaggctctttactccaagggcaactttaaaaaaaagaagttaattctttcttaatgtatctgaaattaatcaaatattgtgtatcacaaaaaaaataatcaaaaaatcaattgaagtggacgcgagagagtatttttttcttatttttttgccactttcccctcattctttatctacaattcattcaatttatgtttattaattccaaaagtcacaacctaaatcgtttcggttaccaaaaacaacagattaaactgttcacacaacttaaaaagttcccgttaccaaaagtcacaaactaaaccgttgctattacttagaaacatcgaaagtttcatcaattttgtcttttggggtaaatataaaaataggacatagatgaaacaaaaactctatgcctgaatcaacaacgaaatcaaaggtttacttatctaaatgtattaactttttttgtcattttattatacgtttattaatattcacttaaaaatatttatttatttatttattgttcatcttttctcaatatgcaaaactatgtgaagttacgtgagaagtattgcgtgccaagtgattcatgaatcataacaaagttaaaatcttactcctttaatggctgctgtacgtacatcaatatttctagtcgtgttattctgtaccaactatgctacaaatttatgcaatacttttgtattagattgtaatggaacttattagttgattttgcttttacatttctatttataagtttcttatttgacttttaatgcatcactcagtgttggactttaagccattgggctttaaagtagaagaagtgtgaattggaaatggaggaaaataaaatggagggaaaaataaaaatttgaagaagtgacttttgtcttgcactttgtccctcattggtgagggacaactacatttgtgtgcttatatatagaatcacttcttaaagctcttaaaaggagttgaagagaatgaaccctcgcgccgtcgtcgctcgctcggctttggatttggatttggatttggatttggatttgtcaaatgatcgacaagattatttttggacaaaatttacttaattatttaataattaattaaattccaaatcactactgaaaatacaccagaacaccagaaacgcggcagccagattcagagagcttctctgaccgcggcagatcgcggtagaaccgcggcaggcagtgtttctgctgaaaaggcaccttttccagacacctcttctgatatttgcctataaattctgaggcaagacttcattttctagacacgaaaaacagtccagaacttctttctttttgaatatactgcatcctaattcgcagtctctctctctcaaattcgtaagtgtgattttgctccgttctttgagttcgttggtatcctgctgtttgtattgccactgttgcaggaaggtttattccgttttatcctggaaggatttaatccattaccttggcaacgtgtgagggggttaaaattccttaaggacacacaagaaacttgtggactcggaatatttctgattctctactattttcagatttctttaattcttctaacagttttctgtcttttgttttaacacagtaacgctcacaagcttaagaaatttttatttatactaacgtttctgtgttgattatatattaaactgtttttaatatactactttggagactaaagccttgttgctttctactccaacaattgtttctgtccggtttaaaatatataaaaactttgccggaataataaacgtacgggtttgaagtatataaaaacttcaccattgttacatgttgtatgtttggtttggtattcagtttgaagatatcaaaacttcactgatttaacaaagttctgtatttttttcaactttacagaaatatgacgaatgaaaaccaaactaatggaagtgttgcgggaacgggtgctattgttacgagtgttgttgcctcgtcaagccgttctactcctgctcatgctatggcaccggcagaaaaacccgaaaagttttccggtattgacttcaaacgctggcaaatgaagatgctcttctatcttactacgttgagtctgcaacggttcatcaaggaggatcctccggttatggctgaaaatactccggatgatgaacgatttgtagtaactgaagcatggaaacattctgaattcctgtgcaaaaactacatattgagttgtttggaagatggcttgtacaatgtgtatagtgtcatggaaacttcaaaagtgttatgggatgtgcttgagaagaagtacaagactgaggatgccagacttaagaagttcgtggctgcaaggttcttagatttcaagatgattgacactaggttggtcataactcaagtccaagaactacaattcattgtacatgatctccttgctgaaggtatgacccgaatcaataattttattaataagatttatcttattattaattgtgaatttgttgctgaaggtatggtcataaatgaggcctttcaagtcgctgctttcattgagaagttacctccgttgtggaaggattttaagaactatcttaaacacaagcggaaggagatgacattagaagacttgattgttcgtctgaggatagaagaagacaacaaaaatgctgaaaagaagtcacgtggacactcgacaataatgggggcaaacgttgttgaggaggcaccacaaaataagaagaagaagaaggcctctggaccaaagaattacccaagcaagaagaagttcaagggtaatttccacaattatggaaaaactgggcataaggcagtggattgtcgtgcgccaaagaatgataagaagaaaaagaatcaagccaacatggttgaagataaaatggaggacttgtgtgccatgttgtctgaatgcaacttggtaggaaatccgaaagaatggtggatagattctggagccacccgccatgtgtgtgctaacaaggaattattttcttcttatgcccccgcaggacccgacgagacaatcttcatggaaaattcatctacggccaaaattgaaggaattggcaagattgcattgaagatgacatcaggaaaaacagtgactctaaaccaagtcctccatgttcctgaaattcgcaagaatcttgtgtctacttcacttcttgtcaagaatggattcaaatgtatttttgtttctaatagtgttgtactaagtaagaactatttgtatgtaggaaaaggttacctaaatgagggcctttttaagcttaatgtaatagcagttcctatcaataaagtgaatgtttcttcttacttacttgagtcaaacactttatggcattcacgtttaggtcacgtaaacttcaaaacattgcgaaagataataaatctagaagtattgccaaaatttgattgcatcaattccaaatgtcaaatatgtgtggaatcaaagtatgctaagcatccttataagtctgttgaaaggaatttaagtcctttagacttaattcacacagatatttgcgacatgaagtcaacaccatctcgcggtgggaaaaagtattttattactttcattgacgatagcacgagatattgctatgtttatttacttaatagtaaagatgaggcaattgatgcattcaagcaatacaagaatgaagttgaaacgcaactaaataaaaagatcaaaatgataaaaagtgataggggtggcgaatatgaatctccttttgaagaaatatgtttggaaaatggcattattcaccaaacaactgccccttactctcaacaatcaaatggaattgcggagagaaagaatcgtacattgaaggagataatgaatgcattgctgataagttctggcttaccacagaacttgtggggggaagctatacttacagctaaccgaataatcaaccgtgtacctcatagtaaaacacaatccattccttatgaaaagtggaaaggaaggaagcctagcttgaaatacttcaaagtgtgggggtgtttagctaaggtacaagttcctaaacctaaaagggttaagataggtcctaaaacggttgattgtgtattcattggatatgtaaccaatagcaaggcatatcgttttctggttcataaatcagaaaatccttagattcacgttaatacgataatagaatcagataatgctgaattctttgaaactatttatccgtataaaacagaaagtgaagtaacctaccaaaagtcaaaacgacctcgggagaaaaaaacagatggtatgcctaatgaggaaaatccgagaagaagtaaacgtcaaaggacctctacttcattcggtccagattttctgacttttctgttagaaaatgagcctcgtaccttcaaggaagcaatgtcttcctcagaggcacaatattggaaagaagctgtcaatagtgaaatagaatccatattgagcaaccatacttgggaattggttgatcttcctctaggtaacaaaacgttgggttctaaatggattttcaagaagaaaatgaaagacgatggtactattgacaaatacaaggaaagacttgttgtcaaaggatttagacaacgagaaggtcttgactattttgacacatactcgccggtaacaagaattacatccattcggatgctaatagcgttagccgccttgtatggtctttaaatccatcaaatggatgtaaaaacagccttcttaaatggtgatctagaggaagaaatttacatgaaccaacctgaagggtttgtggttccgggaaaagaaaagaaggtgtgtcgacttgttaagtccctttatggactaaaacaagcacccaaacaatggcatgcgtaatttgaccaaacaatgttgtcaaatggttttaagatcaatgaatgtgataaatgtgtctacattaaaaacgttccaaaacatatagtcattgtttgcttatatgttgatgatatgctaataatgagcaaagacattgccgacattcaagctactaagcgtatgcttgctagtaagtttgatatgaaagacttaggagttgccgatgtaattctaggaattaaaatccaaaggactcctcaaggtctagctttgtctcaatcacattatgtgaaaatggtacttgaaaaattcaaacaattggaatttagaagttcaagaactccaattgacttaaaccatcatcttatgaagaataaaggtgaaagtacgtctcaattggagtatgctcgggtgttgggaagcttaatgtacattatgaactgtacacgacctgatatagcttgtgcaataagtaaccttagtcgattcacaagtaatcccaacaagcatcactgggtggctatgaaacgagttctgggatatttggagtatacccaagactacgctttgcactataataaatatcctgcggttattgaaggatatagtgatgctaattggataaccggctcaacagaaataaagtccacaagtggatatgtgtttactattggtggaggagcagtatcttggaagtcttccaaacaaacgtgtatcgctcgctctacaatggtatcagagtttatagcgttggataaagccggtgaagaagctgaatggcttcggaattttttagaagacattctgttctggccaaaacctttggctcctatttacatacattgtgatagtgaggctgcaataggatgggcagggagcgttatgtacaatggaaagtctcgtcatatacgactaagacataacaccgttagacaactactttctagtggaattatcactattgattatgtaagatcaaaggataatgttgcggatccgcttacaaaaggcttaactagagagggagttgagaaataatctaagggaatgggactatggccaagtacaagtcaacatggcggtaactctacctagaattttggatgttccgagatctaggttcaaggagctcaaacaaagttgtgattgaccggttcaacattgtcaaaataaatactttggtccattctcgtgatgaagacaatgttcagtaacaaggatagaactttacacgttctttaatgattacctaagtttgatgaggaatttatcaaatagtgtcaatctaaaggattacacgtttaggaatcacctatgtaagtgtgaagtggaagccgcttcaaggagaattctgtaaggccaattctctacgcgcttatgaaatcaggcggtgttcatggctaaaacgaacacaacaatgagaaccaaaagacggttaagggttggttgtgtgacatatggttgtctaggtatacactaaagttcgacggttcaaagatatcaaatctaccgattgaccgagtatatccgacatatgttcactacggaaagttcaaagggaaacctacttatccagatgcgattaatccttacttgcaaaatcacatagctttcatctatgatctttcttgatatagccattcccattcatgtgggggattgttggactttaagccattgggctttaaagtagaagaagtgtgaattggaaatggagggaaataaaatggagggaaaagtgaaaatttgaagaagtgacttttgtcttgcactttgtccctcattggtgagggacaactacatttgtgtgcttatatatagaatcacttcttaaagctcttaaaaggagttgaagagaatgaaccctcgcgccgtcgtcgtcgctcgctcggctcggctttggctttggctttggatttggatttggatttggatttggatttggatttgtcaaacgatcgataagattatttttggacaaaatttacttaattatttaataattaattaaatgccaaatcactgctgaaaatacaccagaacagctgaaggttcagagggcctctctggccgcggttctgccgcgaccgcggtagaaacgcggcagccagattcagagagcttctctgaccgcggttctgccgcggtcgcggtagaaccgcggcaggcagcatttctgctgaaaaggcaccttttccagacacctcttctgatatttgcctataaattctgaggcaagacttcattttctagacacgaaaaatagtccagaacttctttctttttgaatatactgtatcctaattcgaagtctctctctctcaaattcgtaagtgtgattttgctccgttctttgagttcgttggtatcctgcagtttttattgccactattgcaggaaggtttattccgttttatcctgggagaatttaatccattaccttggcaacatgtgagggtgttaaaattccttaaggacacacaagaaacttgtggactcggaatatttctgatttaccgcggcaggcagcatttctgctgaaaaggcaccttttccagacacctcttctgatatttgcctataaattctgaggcaagactacattttctagacacgaaaaacagtccagaacttctttctttttgaatatactgtatcctaattcgcagtctctctctctcaaattcgtaagtgtgattttgctccgttctttgagttcgttggtatcctgcagtttttattgccactgttgcaggaaggtttattccgtttatcctgggagaatttaatccattaccttggcaacgtgtgagggggttaaaattccttaaggacacacaagaaacttgtggactcggaatatttctgattctctaatattttcatatttctttaattcttctaacagttttctgtctattgttttaacacagtaacgctcacactcagttcatctctttaattcttttttttcctttaattttgcgcggacaatatgtcaatacattagtaatattataacattgaccatgtgctagaatgcgtaggaagcgtgaaataattgtactattagaaatctgaagattttttttttggttgaaaggataaacatattatagataataagaaggttatacataaacattttggaggtgcagaacttgcaccagattaccactaagttgtgcaacaggagtatcaacagtactgttgctactattactactaccaacattacctttactagtaatatatctactactatcactaccattagcaaccctagtactagatttacataatcgtggtcgaagcaacccttccttgtcctgctggcaaaacagtgtaacaaaatctggaggacttgaaaaggtacacaacatgcctccatattggctgccccgtacttggctaaacagtccgcaacaaaattttgttccctgtagatgctgtgcacttctggatcatccagctgatggagtaacaacctacaatcaacaatcaagttattatatctaataacaggatttgagagcatatgaattataacagtggcatccgtttcaatgatcagtggcttgaggtcttgctgaacaaccaatttgagccccattaatagtgcaagcaactctgtctggatacttgattcatccctagcatgacctgcaaatcctaaaacccaatctccctgcttattcctaaagcaaccccctataccattaataagattatttgttgaggatccgtctatatttagcttaaaaaactgaccctccggagggtgccatttaatataaattgggaagagagcagtgtttcttattgcagtgtttgtgaggtagtgatactcagcagcttgtttgtatagcactaaagcacttattttaataactttatggtcaaatacatatctgtttctgattgtccataagtaccataaagcaaaaggtagcaaggtttgaaaaggaatgctagcattgggacttttgattctggacaaaagatgaaatctgaagattacttccatgatcttcggcagattttctctattcttttcaatatttgtttatgtattatttaagaaattagtttataattacaaagagtgaacattctgaaattaagaaatgctagaagagtcaaaagaatgatttagcactcaaagtggctttccatgagtgcgtcactctttttttctttagtaactacgtgaaacacgaacaatttcactagtaacattatattgttatgaaattctttttacacatttgtatagagatagttgagagagttcacaaactagtgtgtaccattttaatctgacataaattctcaatttattgtttatgacatgctcttataatcacaagtcctaatgagatgtacaaaaagccctttttcttatatgcatgaaggcaagtacataatgagaattccgacatataaatcgcaattattaaatgcgaattaatcgcatttagcaaatgcgacttataaagcgctttttttctcaattcggcttattaatcgaactttgtaaagctagttataatagtataaatgcattttcaaaaccaacttacaaaccgcatttgcgatttatgagcacaaccataaaagtaatcatcttgtccatcacacacattccatatataagaacgagttgcttcacataacccgttttcggaaatattctgatattttttccccggatagttttgacgaatgaggccggatatggggagggggttgaaacagattagtaaaacactagctacaggctgcaatcaaacactgccctaaaaaatgaaatagaacatagtagcaaactgtaaggtgtttgtccagattttgttaccataattagttttcctatctcatgaaggaaaggacaacatatttaccatcattggaattttcttttcctagaaggaaaatataattcttccatatttggctagttccttttcttgtaggaaaatgtttggagttctataaattgaatatccgtccttctcattcagtagcatccacaatgcagtcatatggggtttgagagtcttgtttagggggagaactttacaggacaagcaggggcggatttacatggtggaaagcggtgtcacgggacaccgcttcgtcgaaatggctcatctatgccatccgttaaaattttgctatatccatgccattgccgttaaagaaatggcccagatatgccattcctccgttagaaaatgatatttttcagttttttcatttttttttttttttgtaaaaacttgaattttttttttagtaaaaacagaaaaaaatctttttaatgaaatatttttgttttctttaaaactgaaaaaatattttcaacaaaatatttttatttttgaaaaatattttatcagttttttttaaagcatttcgttttattatcgtttttcaattttttataaagaaaaaatatttttatttttgtaaaaaaattggaaaaaactaaaaaaatattttttaaaaatgaatttattttgttgaaaatatctttgaaaaatacttttttagtttttttagtttttttaaaaaaattaaaatattttttctttataaaaaattgaaaaacgataataaaacgaaatgctttaaaaaaaactgataaaatatttttcaaaaatgaaaatattttgttgaaaatattttttcagttttaaagaaaacaaaaatatttcattaaaaagatttttttctgtttttactataaaaaaaaaattcaagtttttacaaaaaaaaaatgaaaaaaattaaaaatatcattttctaacagaggaatggcatatctgggccatttctttaacgataatggcatggatatagcaaaattttaacggatggcatagatgagccatttctgaaagttcagtggcatatttaggccttttccgtactatttatatatataaaaataataagtaaaacagaaatacaagataaaccattaaaagtgacaccacttgcaacaaaatatcttagtagtctagtggttgttagcttcaagtattatgtgagatgtcttgggttcgaactcccttggctccacaaaatattttttgactgttatgtcccttttactagaaatagtgacaccacttataaaaaatcctgcgtacgccactggggacaagtgttagtgtatcacttgtgtttgcctcttcgtgaggttgttctctcgatattttatactctcttttatatagtggattgcccatctccatttatggatgtaggtcaattgaccgaaccacgttaaatatttgtgtctcttttggtggatttctccttttgttgtcatatttatcgtcgttgaagatttgctttactagcttccgcatgacacctgatcttttcgatcctaacaagtggtattagagcgaggttaaagacaggttcatcttggcgggtttaattctagccgcaacctagttgacagtaatcataatttttgcctgagaaattagaccagagtgctacgcatgttgagacaaactttgtgtggagatttggagatgcgacctgttgaaggctatgtgaagaaggtggatcatgtttattttttcagaaaattcaggacaaaggggagaattgttaggtgcttgtttagattttcttaccataattggttttcctatcccatgaagtaaaggacaacatatttaccataagtggatttttcttttcctagaagaaaaatataattcttccatatttggctagtcccttttcttgtaggaaaaggtttggagttctataaattgaagacccgtccttctcattcagtagcatccacaatatagtcatatggggtttgagagtcttgtttagggagagaactttacgggacaagtattagtgtatcacttgtgtttgcctcttcgtgaggttgttctctcggtattttatactctcttttatatagtgaattgctcattttcatttgtggatgtaggtcaattgaccgaactacgttaactgtttgcgtctcttttggtagatttctccatttgttgtcttatttatcatcgttgaaggtttactttactagcttccgcatgatatctgatcttttcggtcctaacacaaagaatgattataaaagaaaagatataatataatctatattattataaaagcacgaataatttatatgacgacccgacccgtcgtcactggtacttctgacccgttatccccattatatgattccccgtgtgtaattataggtgtttggtatgtttgaggtggtttggattgaatttggatagaaatgggacaaataatctctttaagaaaagcttaaattggaaaagtcaacccaacgttgacttatgagttagagggctcggaacggatttccgatggctcgactagttccgggggatgatttgtgacttaggagtgaaaacggaagtgaattcggaggttcgtaggtcattttggagccatttggctaaagatagcaatttgaagaattttgatattaatattgatatagttgacttcggtcaacattttgggtaaacggacccggacccgtgatttttcaatttcggaaaatccgtagaaaaatatgggacttggacgtatttccggaatcgaattccgaggtcctaggttcgaggaatgaatttttctgttaaattattttatgaaaatggttcaggaaaatgaaaatgaaatgtgatcagaaagtaatggtatcaggcacgtattttggttctaacgcccggtataggtcatatatattggttaagcgcttcctgtaaagtttggttgaaaacggacgttgtttgacgtgtttcggacttaaattggaaatttgaaagtttatgaaatttgaaggttttaagaaatttggccggaaatggaccttttgatatcggggtcggaatctgatttcggaagttggagtaggtccgtaatatcaaatacgactggtgtgcaaaatttgaagtcaatcggacatgatttgataggtttcgacatcggaaatagaagttggaaacttcaaagttcatcaagcttggattggaggttaatccatgattttagcgttgtttgatgtgatttgagacctcgagcaagtccgtaatgtgttttgggacaggttggtatgattggttggggtcccgggggcctcgggtgtgtttcgggttgtgaatccactcttaaccgatgtttcaatgttgcatctttggacataaatgggtataatgttaatcaaatgagctccaaattcagttttgtttgaaccattagatccgtatcgaaatttcggagccataagaaaaagaatcgtcaaattccgagttcatatgaggaagttatgctcgtttctgtaccgagggaaatctggccctgtcataaccgcttatgcggactttgaccgcgtaagcgggaccgcacaagcggacaaaagaccgcagaagcggtcccagataagacaaaaagtccgcttaagcggaaagttgtccgcttatgcggtccggacagtgtattaaccgagcagttcagtgttttggccataacttgagttctagagctccgattgaggcgatatttggagcaaaatgaagagggtttcgatgggaattgattggaggtaagtttcttgacttagaaacatcatttctttgaagatttaacttgtaaattcatggaattaagctaaaaatggaggttagggcttgaaacccaacaagactttaaatgatgatttgaggggtcaaatggactccgattttgatgaactcgatatgtacggactcgtggcgagacgagaattctgaaaatgtaaatttcataatttttcgagaagcgggcccggggctcgggttttactagtttcgagattttggctatttcttggttgcttttgattgggtattgtctcatttacatattgtgttgtattcgttgtggttttggatagattcgacgcacgtggaggccgaattgttaggcaaaggagtcgcgggcttgatatttcgccggtttgagatgagtaatgggtgtagatgaatacctgagggttcgaaaccccggtatatcacattgtgacgctattgtggtgttagacacgcactccatggttagtgcggggttgtatgagttgtgaattgtgactcggtccaatccgagagataaattgtgtatatatattgtgatatctgggcttgatgccatgtttggggcctagtgccgacctgtgatgtccttcgggagttggtattactgtttgtcatgattgcatatcattttatatcagtccatggttttaaaacactattttacaaacccagccgcattttctaagtttcaaaactcatatgctatattttaaatgcatttcggctgaggaccattgttataaatgcccaaggggcttatgatacattttctggactgattttgggtggctcgggctgcacgccgcagcaagtactggattgtacgtaacacgcatgatatcgcatcgcattgcatccatatacatatgcatgggtggctcgggctgcgcgccgcagcagtaatataatcggtcaggtaacatggactggcctggtattgattattatccacgagatggctgtccgccgtgggccctatatgggtagatccggtgagacttggtattgtattcttccaccgtgggccctatatgggtagatccggtgagacttggtattgtattcgtccgccgtgggccctatatgggtagatccggtgagactgggattgtatttgtccgccgtgggccctttgtgggtagatccggtgagacgttggactgcacttgaccgccgtgggccctttgtgggtagatccggtgggacgttacagagcatcatcatatgcattgcattgcactcatgcatttgttctcattttgtcaaggttgtcatgacattcagcactcatatcattggcatccatactacttcttgcactgtttaccagataccctgatgttgtttattgatggagtgctgggcccgagaggccgttatctgctgatgagttgggagtgagcccgagtgactggtactgtacgtgaggttgatattgagcccgaggggcgagttctggataaatcactactgttgctattggttatgacttagtattgagcggtgttgttagctttacaattgtgttatattgtgttttcctgctttcaggctttcatatacatttattactcactaagttggtagactcaccacatactccctgtaccttgtgtgcagattcaggtgttgctggaggcatagttttgcttttgccgttggttccagattattcagagtatagaggtagctgccagcgtccgcaggacctcttctccgatccttgttatgttctttccagtatttttgacttgtatcttctctatcagtttgtatacggtatatttagaggctcagtactcgtgacccttgattttgggagttattgttggatcattagtgtctcactcgtcctgttttggccctgaatgggcaggctgatatatgaattgctgttttaggcaggaaatctcttcctgttggggctgtaacgccattgttgagttgatgtggtcgggcttgcctagccttgcggccgggcgccatcgcgaccgggatttgggtcgtgacaacttggtatcagagcctaggttgctaggcctcacgagttatgagcctgtttagtatagtcttgtggatcggtacgtagacgtccgtatcatatccacgggaggctacagaactttaggaaaacttcacattcttggaattcttatcgtgcgtccttgattcagcttgaaagagtaactcttgaaattccttcctcacgtttggagcactcagtaatatatgtgccttgatggctgatgatttccccggtcgagggccgagttatgatttctatgagttgatgttgggccagtctggaggacttgaggccgaatttctgtctatggcttgagcacgaggtgctgattctacgagctggtattatgagcttttatgtctagtattgtccttaattgtggtaatggcggctgaatagcttcaggaggagtacgttggtgtcgtgtgatatgtttgtataacatggtagtgtcgaaggaggtctgctagatgttaaatgaatcattaagtgtttgaattccattgcgatcgaatgagttgcccgagttatgggtgcgtgaagaatattttcgagtctcctggttaggagtgtatgtgttgtggtatgagtccagactcagtaacgccaattgattgcgtgaggtattaatggtaagtgatgtaccgaaattttatatggaagcaagcaggtgggtatctcctacagattattctgaagtggcatgcttattatgtgtaattaaaggtatatttccagatgttatgatttaagcaggtgcaacgcatgtttaggtaccaattttgataatattgtacgtgtagcattgagattgatgctattgatatacattgtgatattttgttctgttgtggacatgttgttaggatggttttggtggttctctgacaggtggataggcccagttacaaaggaaactctgccgaaattttcggaaaatttgggacttagaaaaaaaaatttgtcatcttaagagtggacttaacggttgtgtgaatgaatgcaaaagttgaagaagagttggaatttctgatgattcgtgtttccacaagcttatgaaagagtgagttcaatctcgccatgatgttatgatggttatagggtatgtgtgtttaatatttatatggcttcgagctaagttggggaggttgctgttgaatagctgattgtacggttatgtactatgattagttccggtttgatgcatgtgtgtgaattagttctagctgcagaaagtgagccgagggtggcacaagtgaagcaaaattttgccaaagattatatgatacttcgtgggtgtgagaaaataagggagttgttcggttgtatcagaatgagagcacgtcttgcggtgtcggattgctgctaaggtacgagtggtttgattcgttaagtcaagtaatttgcggtgtgtataagagtggatgacttttgagaatggttttgatgtattcagaattctatgagtgtcgctccggtgttttaaggttgcgtgtgtggtcagagacagtgttctcagtggagatgtcaagactggtggtatttttaagctaaccatgagaccctatgtatcagtatcaggaaggtagaggaagcaatgttaggttcgcaggaagttctttagagaaaggcattctgaaatgcgagtgttactgggaatatgtgaaagagtatctagcaatttatagaactcgtgtagtaagtatgggttgaaagattggggtgctacagtaagagagtatgttcagctgaaaatgaatcaggtgagaatttagtcagataaagtaacctgtgagtggaccgaatcggtatgttaagggtatgattgttctcattatgtattcggggtaatggtttagcacatgtaatttttgcagcaatgctcttggatgttgacgattctctatgtgtgtcgtaattaaaaagggttcagtcacggcggtttagttgtgcaggtggaatttgggagagttctcgttgatttatacatggttgaagagatgcaccttctacggatgcgagatggcatgagatgtatgataattttcttctaaatggatcaatgaaagttctagactagttgggtgcgtcgatatctgcggcgcagaaaggagatgaaagatcttgtgttatcctgggaggatacggtatatgcggtttgttgtaaaggcctgagataggcatagtgcaaggtttcagttcagttctgaaaggtatggcaggttggttaagtcttaagtgacgagtagcttcaggtgatcaagaaaatggtactattaattggaagtgatttggcgatggcatatgtttctgaaagagggtaatttcacaaatgatacatcggtagtgttacggcatatttttttatgggatcaactgcgggtatctgagttgtttgatggcgcgtgggagttttaaaatatctctcctaggataactgagcattggaggtgtaatctgaattttgcattgtggaaatttagatctggtacagtatatgtagtggctatgaatcgcgtgatgtgttgaaactgtcagcaactattgggagatgagaatctggatatattatgggaatgtgtagactgttcttgttggtgcgtgtattatgcaattgtggcttagtcctgtaatgagttatcatatcaccagaagtggtgtgtttgattcgatgtgatcattggggtcattaatgaatatgaacaggcttggtgtcagctggttagaaagataacatcgagatttggcccagacatctgttatggtaataatcagcatgaacgtgacttcgtaaatggtgaatctgaagaactactacaattcattgcgtgtttggttatcgttggcaatatgcggaagtgttagaataagactttagcaaaatataagaggttatctattggtattgagtactgtgggcaactactatgaataaagaatgttgaaacgtgtggtatattgcgtaaattcacctgaggttgcaggtgtgggttattacagctggttcggattaattctgagtgtaggtgtgaatttctgatcttgtgtatggtttcgagaagtgcagtgtggttctatggttcagggttcagatggattgtggaatttcagttgtgttgtgttatcggttcctatgggagataggatgatgtgggatcaccccgggcatatactcggtaatgtcatttggctattgggttgcttctagtacaactccgggtacgctcgaggacgagcgtttgtttaagttggggagaatgtgacgacccgacccgtcgtctctggtacttctgacccgttatccccgttatatgattccccgtgtgtaattataggtgtttggtaagtttgaggtggtttggattgaatttggatagaaatgggacaaataatctctttaagaaaagcttaaattggaaaagtcaacccaacattgacttatgagttagagggctcggaacgaatttccgatggctcgactagttccgggggatgatttgtgacttaggagtgaaaacggaagtgaatttggaggttcgtaggtcattttggagccatttggctaaagatagcaatttgaagaattttgatattaatattgatatagttgacttcggtcaacattttgggtaaacagatccggacccgtgattttttaatttcggaaaatccgtagaaaaatatgggacttggacgtatttccgaaatcgaattccgaggtcccaggcccgaggaatgaacttttccgttaaattgttttatgaaaatggttcaggaaaatgaaaatgaaatgtgatcagaaagtaatggtatcaggcgcgtattttggttctgacgcccggtataggtcatatatattggttaagcgcttcctgtaaagtttggttgaaaacggacgttgtttgacgtgtttcggccttaaattggaaatttgaaagtttatgaaatttgaaggttttaagaaatttggccggaaatggaccttttgatatcggggtcagaatctgattccggaagttggagtaggtccgtaatgtcaaatacgactggtgtgcaaaatttgaagtcaatcggacatgatttgataggtttcggcatcggaaatagaagttggaaacttcaaagttcttcaagattggattggaggttaatccatgattttagcgttgtttgatgtgatttgagacctcgagcaagtccgtaatgtgttttgggactggttggtatgattggttggggtcccgggggcctcgagtgtatttcgggttgtgaatccactcttaaccgatgtttcaatgttgcatctttggatataaatgggtatactattaacaaatgagctccaaattcagttttgtttgaaccattagatccgtatcgaaatttcggagccgtaggaaaaagaatcgtcaaattccgagttcgtatgaggaagttatgctcgtttctgtaccgagggaaatctggccctgtcataaccgcttatgcggactttgaccgcgtaagcgggaccgcacaagcggacaaaagaccgcagaagcggtcccaaataagacaaaaagtccgcttatgcggtccgaacagtgtattaacctagcagttcagtgttttggccataacttgagttctagagctccgattgaggcgatttttcgagaaaaatgaagagggtttcgatgggaattgattggaggtaagtttcttgacttagaaacatcatttatttgaatatttaacttgtaaattcatggaattaagcttaaaatggaggttagggcttgaaacccaacaagactttaaatgatgatttgaggggtcaaatggactccgattttgatgaacttgatatgtacggactcgtggcgagacgaggattccgaaaatgtaaatttcataattttttgagaagtgggcccgtggctcgggttttactagtttcgagattttggctatttcttggatgcttttgattgggtattgtctcatttacatattgtgatgtattcgttgtggttttggatagattcgacgcacgtggaggccgaattgtgaggcaaaggcgtcgcgggcttgatatttcgcctgtttgaggtgagtaatgggtgtagatgaatacctgagggttcgaaaccccggtatataacattgtgatgctattgtggtgttagacacgcactccatggttagtgcggggttgtatgagttgtgaattgtgactcggtccaatccgagagataaattgtgtatatatattgtgatatctgggcttgatgccatgtttggggcctagtgccgacctgtgatgtccttcgggagttggtattactgtttgtcatgattgcatatcattttatatcagtccatggttttaaaacactgttttacaaacccagccgcattttttaagtttcaaaactcatatgctatattttaaatgcatttcggctgaggaccattgttataaatgcccaaggggcttatgatacattttctagactgattttgggtggctcgggttgcacgccgcagcaagtattggattgtatgtagcacgcatgatatcgcatcgcattgcatccatatacatatgcatgggtggctcgggctgcgcgccgcagcagtaatataatcggtcaggtaacatggactggcctggtattgattattatccacgagatggctgtccgccgtgggccctatatgggtagatccggtgagacttggtattgtattcgtccgtcgtgggccctatatgggtagatccggtgagacttggtattgtattcgtccgccgtgggccctatatgggtagatccggtgagactgggattgtatttgtccgccgtgggccttttgtgggtagatccggtgagacgttggactgcacttgaccgccgtgggccctttgtgggtagatccggtgggacgttacagagcatcatcatatgcattgcattgcactcatgcatttgttctcattttgtcaaggttgtcatgacattcagcactcatatcattggcatccatactacttcttgcactgtttaccagataccctgatgttgtttgttgatggagtgctgggcccgagaggccgttatgtgctgatgagttgggagtgagcccgagtgactggtactgtacgtgaggttgatattgagcccgaggggcgagttctggataaatcactactgttgctattggttatgacttagtattgagcggtgttgttagctttacagctgtgttatattgtgttttcctgctttcaggttttcatatacatttattactcactgagttggtagactcaccccacactccctgtaccttgtgtgcagattcaggtgttgctgaggcatagttttgcttttgccgttggttccagattattcagagtatagaggtagctgccagcgtccgcaggacctcttctccgatccttgttatgttctttccagtatttttgacttgtatcttctctatcagtttgtatacggtatatttagaggctcagtactcgtgacccttgattttgggagttattgttggatcattagtgtctcactcgtcctgttttggccctgaatgggcaggctgatatatgaattgctgttttaggcaggaaatctcttcctgttggggctgtaacgccattgttgagttgatgtggtcgggcttgcctagccttgcggccgggcgccatcgcgatcgtgatttgggtcgtgacaatttatgctaaatgttgtacgactaaaatatccccgaaatatcaaccgacttttatgcccttaaaaatttaaagtctttctttactatataatttcatattggataaaagtgtaaaattaagagaatttctctcatactaggattttgaaattatcgtcactagactcggatactatacctaatttgtaattgattgtaattaagtgatgacttcaatcctctataaataaaaaccttttgcttacaaagtttacacgtaatttgcataagtgttgtttgatcatgagtttctgctagcgatagatgccaaagccaatccgcaggaattttttttatctaatctataatttatttcatatttatagcaacaatgattgaatcaggcttttgttattattttttattgatattttttgttcatcgtgtacccgtgagattgaatttaattcacttacttttcgccttgtcttcctcttaaatttgatgcgaaggtttagatgccagcaaaaagttcgataaatcaaaataacaaatcatacaaaatagattgagagattattcgctataacgcgtggtttaattgcactaacatcgacatctaaggtaatgaaagaattgatctttttcctttacgtgtttggcaattatgttatcattggttactatttttttcttaggcggttctttgctttgtctaattgatacatggcataaaaatatctcacattcgatgcaccaaagttatatattgtctagcatataacatgcaaaggatttgttctttgtatgaacgtaagttgacagtccaagctagctatctgtacctgtgcattggtgtttttttcggaaaaaggttatgcatatgaatctattttgtgatccatcataatatatatgtcgttctttctctgttacttttctgcttttgtattagtctaaactctcttcttttgttaaaatttcaagcttctaagtgttcaaatttatgcaaaaactaattatgcggagagaatgaggcaacttttgcagatttgattttagtatcaatatttatattatgtattgtaggatgcatattggttgcccgacaaaaagattgtttcattaatgaaagtatatatgagaaaataagagtttggtgtgctgaattgaattgtgagaaagtgtatactacatagaaatagaagatttatctaggacattgcctaataataaaaatttaaagtcaattagaagtttgtgtttaatggaacttgcataccatttaaccactcaaaattgtttcttaggaggaatcatatgccattcacgtttcacaagttggacttgcaatggaactagaactcttcctcacaagtaaatcctttttactaagagatgtttattagtttgtgctttataaaacaagtccagttatgaactgaaaaagttagaacaataggatacgaatctcaagggaccttttctcatattttccaacgatatagaatagaaacaataggaacaattggggtaaggtctgtgtttcccaaaccccatttgtggaattatactggattgttattgttgttgtagtataaaatagaaataaatctcatagaacgtcattaatgttctcaaaattgcaatagagtagaaagaactaaccaagtacctcataagacaattagacaattaaaggaataacattaatattgtcgaagacgactagagtaaagacaaataaagtaaccacaaggtcacttaagatttctcgaagatgtgacaatggcagtggcgtacgcaggatttcttataagcggtatcattatttctagtaagaggcccgtgagagcaaaaaaaatattttgtgttgctaagggattttgaaccctagacctcttacatcaaacttgaagctatcaaccactagaccactaaactattttgttgcaagtggtgtcacttttattgcttttatcttatatttctgttttacttattatttttatatatataaatagtaaaaaatttcgacgaagcggtgtcccgtgacaccgcttgaggccatgtaaattcgcccctggacaatggatattaaaaagtataacaaaaaatgtttactaattcgtcacattaatggagaaaagcataaataaaaaagggaaaagaaggaagaccaaaaagaacggtggtaaattaattataagagtatgaatgataacaattatagattaactaatatgctaacattgttgatatattcaaagaccaaaagcgtcttctccttgttatagtggaaacaagtttttatagttaaaaatctgacaaattaattcatatgctcgcataggtcttctttaccgtaatatgttcatataagtaactaaaaagtaaaaaatcataccgaaacattcatggtatgaattaactaaaagagtggtatctttgatatcttcgtatgatgcatgaaatgatcaactcttttttttttttttttaacaagaattaatcgccgtttaatttattgtccttttattttaagttctaaaacattacgtgcgaggcacgtacataaagactagttaacttaaacatagggatgacaattacatgcaaacgaaatcaagacatgcgtgaattagttctcatataataataacaaacatgacatgaccatccatatccataagaagtgaatggagatttctgatacatttattcttacttccaacacaaaactatattatactatactagaacgcacacaaatcactatacatctttatatccctagataattagttgtgaggcttagcttcagttactttatccaagtcttcatttcctcctccaaatccaacttcatattcactactaggatatgctccgccacgatatccaccatatcctccaaatctgcctctgtgacgacccgacccgtcgtctcttgtatctctgtcccgttatccccgttatatggttccccgtgtgcggttatacgtgttgggtgagtttgaaatggtttgggttgaaattggatagaaatgagacaaatagtctctttaaggaaagcttaagttggaaaagtcaactggacgttgacttgtgagttagagggctcggaatggattttcgatggttcgactagttttggggatgatttatgacttgggagaggaagcggaagtgaattcggaggtccggtgtgaaagttagcttggtttggcgaagttggaattttggagaaaaccgattgataggtgagaatttgatccgagggtcggaatgaaattccgagagttgcagtaacttcgttaggtgatttttgatatgtctgcaaattttcaggtcaattgggcgtcgtttggttggtttcggcatcaaatatgatttttgttaagtcatgtttatcttagaattggattcaatgatttttagtgattttgatgttaaaggtagcgtttttgttgcccgagcaagtttgaatgaagtattaggttaagtttgtgcctttgattggggtcccgggggcctcggggtgatttcacgtggttaacggattggttttcggacttggagtgctgcagaaaatgcagcagctgttgcagagagtttaaccctatgcgaccgcggaggtcctatgcgatcgcatagaaggatggaagagggtgtaccggttgtgctatgcgaacgcgtagaggtcctgcgttcgcattgaaggatttctggaggcttgaggaatgctctatgcgaacgcactgggcttgtgcgaacgcatagaaggaggctgaggctgtgggaatttgctctatgcgaatgcactgaaggagtgcgaacgcatagaagagcggacctgggcagaatgcttttatatgaaatttcatccgcgagcttggctcattttcctccattgttgagcaccttgagagcattttggtgaagattgaagagagtttcaacgggaattgattagaggtaagtcccttggcctagaaacatcatttaatcatgattttgatgaacttgaaaatataagtttcgtaatttttcgagaagcgggcccggggctcgggttttgctagtttcgagattttggctatttctcggttgttttcgattgggtattgtcccattagcattttgtgatgtattcgctctatttttgcttagattcgacgcgcgaagaggccggattgagaggcaaaggcgtcgcggggttgagatttcgccggttcgaggtgagtaatgctagtgaatgttgttttgagggtttgaaaccccagactttcacatcgtaacgctatattgaggcgtgactcgcaccccatgatatgtgcggagtcggatattattgggaattgtgacttggtccatcccgagtgagatttatactatattggcgtatgatacgcacacggtgatgattgatatttggcttgatgccatgcttggggccttgtgccgacttgtataatccttcagggattgattgatagctgggctttatgccgtgtttggggcctagtgccgacctgtgatatccttcgggagttgatattactgtttatcatgattgcatatcattttatatcagtccatggttttaaaatactgttttagaaacccagtcgcattttctaagttttaaaactcatatgttaccttttaaatacatatcggctgaggatcatggtttataaatgcccgagaggcttatgatacattttctggacagattttgggtggctcgggctgcgcgccgcagcggtgattggaaacagtggtaacatggacactgtgtcatatgagcggtcaggtaacatgtgctgacctggttattgattttcgccaccacgagatggctgattattgcgcttgggctgtaggagcccctccggagtctgtatacacccccagtgagcgccgtcgacgataaatgatatgggtggctcggactgcacgccccagtaggtactggattgtaccatcatttgcattgcatagcatctctgcatttgcaccttatatatttgttgttcagttgttctgttattgtggtactctgttagttagcttactttgtgcatttactgtgttttttaccttcggagcttcatttattattattactcactgggtcggagtactcacattactccctgcaccttgtgtgcagatccagggcatgctcaggcggattagatcctgcagcttttcagacatcagcagttcggagcgttgaggtagctgcacggcgttcgcagccatcgaccctcctcccctctatctttatttcctatttttcctgtgtactttcagttgcaaccagatttgtatcagattgcgttgttattctagaggctcagacttgtgacacctgttcctaggggatttgctattggtttcagttcattccgctctgtcttttgggatataaatctctttcgtgttgagactattatttctttattgtctttatctgggattattgagattgtggtcgggcttgcctagccttacggccgggcgccatcgcgaccgggtttggggtcgtgacaacttggtatcagagcctaggttacttgctctcgcgagtcatgagccggtttagtagagtcttgtggatcggtgcgtagacgtccgtatcatatccacgagaggctacagaactgtaggaaaacacctcacattcttggaattcttatcgtgcgtatttgattcagctgggaatataacttttgaaaaattccttcttcacgtttgtatgcgcccgtgagcgcccagtgctatatgtgccttgatggctgatgattccccgatcgaggggcgagtgatgatttctatgagttgatgttgggccagtctggaggacttgaggccgaatctgtgtctatagcttgagcaccaaggtgctgattgcgcgagctagtgttatgagctcataagttcggtatagtccctaaattgcggtaatggcggctgaatagcttcatgatgattactttgttgctgtgtgatgtgcttgtattacttaggagtgtgcgtgtggtggtatgaggccagactcaggaagaccaattgattgcgtgaggtgtatggcggtggatgatgtaccgaaatattatattgaaacaagcaggtgggttagcttcttcggattcttctgaagtggtatgaccattatgtgtatgttagaagatcttaagtgtaattaaaaggtattttctatatgttatgattcgatcaggtgcaacgcgtgttcatgtgtcaattttgataatataatacatgtagtattgagattaatgtggctgatgtacattgtgatgtcttgtcaagttgtggacgtgttgttaggatggttttggtggttctctggcagggggataggctcagttacaaaggaaactctgccgaaatttttggaaaatttgggacttagtagaaattttgtcgcctgaagactgggctcaacggttgtgtgaatgaatgcaaaaagttgaagaagagttgaaatttcggatgatttgtgtttccccaagcttatgagagagtgagcttaatctcgccatgttattgcgatagctatagagtatgtgggttgtgatgtatatggcttcgagctaagttggggaggttgttgttgatgggttggttgctcggttatgtgctatgatagttccgatttgatgcatgcgggtaaatcagttctggttgcagaaagtgagccgagggtggcacgagtgaagcaatgttatatggtgtttcgtatatgtggaggaagataagagaaagtcttgagttgatggtaaggaatgtttagtgttaagagaatgaagttgttgggtatatcagaatgagataatgttctgtggtgtcagagtgccgatagggcacgagtggttcgattcgctaagtcaagtaatttgcagcgggtataagagtggatgacttttgagaagggtttcgatgtgttcaagaatctatatgtatcactcaggtgttctaaggttgagtatgcgatcaagtcagtgtcttcattggaacaggtcaagacttatggtatttttatgttaattgcgagattctatgtatcggtattcgggatgaagtggcaactaaatcagagtcgcaggaagttcttcgggtaaagtactctggaatgtggtagttctgagaacgtttgagaaagtattcagtggcctaagggtcttagacagtgtggtctggtgttcaggtcttgtatattgagcctgggttgaggcattgtggtgctacggaaagagggtgtatcaagttgaaaatgaaccaggtgggaatctaggcaaataaagtaacttgttagtggaccgaatcggtatggcaaggatatgattggttctcgttgtgtatttggggtaatggtttagcacaggtaattttcgcagcaatgctcttgaatgtggacgattctcttggtgtgttgtaattaaaaagggctcagtcatggcagtttagttgtgcagatggaatttgggagagttttggtggattaatacatgattgaagaggtgcattttctacgaatgtgagatggcatgagatgtataataattttcttctaaatgagatcaatgaaagttctagactagttgagtgcgtcgatgtctgcggcgtagaagagagatgaaagtgctcatgttatccttggaggatattgtgttcgcggtatgttgtaaaggaccgagatgggcgtgtgcgagttttcgactcagttctgaagggtatggtggatttggctatgctttaggtaatgagtagcttcaggtaatcaaggaattggtactgttaatcggaagtgatttgtcgatggcatatgtttcagaaaaagggtaatctcgctgatgatacatcagtagtgtgacggcattttcttatgggaacgactgcggatatctgagttgtttgatggcacatggggtttttaaaatatacctcgtggaatagttgggtacttgaggtgtaatctgtatttcgcattgtggaaatttggatcaggtacagtgattcgcgtgctatgagtagtcggagactgggggttctccggcgcagtctatgtagtggatgtgtatcgtggatgttgtattggtactatcagcggctattgggagattggaatccggacggatctttccttgcttaagatattaaactctggatatgaaagggggatgtagagtgattgcctcagtgttggattattcgactcgattgtgctatgagtcatgttgggaaatgccacaggttgcgtagcgaggtgtatcggactatgttctagctggatagttgtgttccagaggctagcggtcagttgggaagaattgtattccttaattgggtcttcgaggcgaatgtcagtatagaggtttctaccattgtttgcggttccggtattgagggacttctcaggtacgtcctagtggccgggcatgtcgccgggcgagactgtggatttcggtaattgtttggtgccaggcaccatatcgtacggcttcgtcatgagttatagtagtgaacgtggaatcttgtagcttacaatgcttttatgaatatctttatgcactcagttgcttcgaccgatgtgggtattttgttgttgtgagcagatttggctcgatgtgcacctccctatgtgaggtatgttatcgggatcgggtggcacgccgccacgagtatgttatctggatcgggttgcgcgccgcaacagtgtgatgttgagcatagctttctatgtattgctttgtattccttgtttcctggcttccgagggaagtctgtattgagaattgcttggcgcttagcgtattggttgtgtccttccaggaccgaatggtgtatattacttgtgtcaccgtgagtgtgttaggtgacttggtttcaggcatagatctgtgcatggctttctactttgagcatggtaacatgagatgtttcatgtgtaataatgttgggataggatcgcgcgttgtggcgaggccacgtgaagttatgacctctcgaggaggattcaggtactttatttctatgatatgagacggggtcccagctttgttttgtgaaggtattgatgagttcgaggtataactctttcggttgagtcggttgccctgatatgggtatgtgtagactgttccttattggcgcatgtattatgcaattgtgtcttagacctgtattgaggcatcatatcaccagaagtggtgcgttagatccgaggtgatcattggggtcattaatgaatatgaccagatttgatttcagctggttagaaggataatatcgaggtttgagatgatagtcaacatggaagtgacttcatgaatggttgatctgaagaactgctacagttcgttgcgtgttttagctaccattggttatatgcggaagtgttggaacaagactttacctaagtaagaggtgttctattggtaattgaattttatgggcagttgctgtgaatagaggctatcgttgcgagtgttggaaggtgtggtatattgcatgaattcacctgaggtttgtaggtgtgggttattacagctggttcggattaattctgagtatagatgtgagtttctgatcttgtgtatgatttcaaaaagtgcagtgtggttctacggcttatgggtcagatggattgtgaaatttcagttgcgatgtattttcggtacctatatgagttagggtgacgtaggatcacccgggtatatgtctggtgacgtcatttggtcattgggttgcttctagtacagctctaggtacgctcgaggacgagcgtttgtttaagttggggaggatgtgacgacctgacccgtcgtctcttgtatctctgtcccgttatccccgttatatggttccccgtgtgcggttatacgtgttgggtgagtttgaaatggtttgggttgaaattggatagaaatgagacaaatagtctctttaaggaaagcttaagttggaaaagtcaactggacgttgacttgtgagttagagggctcggaatggatttccgatggttcgactagttttggggatgatttatgacttgggagaggaagcggaagtgaattcggaggtccggtgtgaaagttagcttggtttggcgaagttggaattttggagaaaaccgattgataggtgagaatttgatccgagggtcggaatgaaattccgagagttgtagtaacttcgttaggttatttttgatatgtctgcaaattttcaggtcatttgggcgtcgtttggttggtttcggcagcggatatgatttttgttaagtcatgtttatcttagaattggattcaatgatttttagtgattttgatgttaaaggtagcgtttttgttgcccgagcaagtttgaatgaagtattaggttgagtttgtgcctttggttggggtcccgggggcctcggggtgatttcgggtggttaacggattggttttcggacttggagtgctgtagaaaatgcagcagttgttgcagagagtttaaccctatgcgatcgcggaggtcctatgcgatcgcatagaaggatggaagagggtgtaccagttgtgctatgcgaacgcgtagaggtcctgcgttcgcattgaaggatttctggaggcttgaggaatgctctatgcgaacgcactgggcttgtgcgaacgcatagaaggatgctgaggctgtgggaatttgctctatgcgaacgcactgaaggagtgcgaacgcatagaagagcggacatgggcagaatgcttttatatgaaatttcatccgcgagcttggctcattttcctccattgttgagcaccttgagagcattttggtgaagattgaagagggtttcaacgggaattgattagaggtaagtcccttggcctagaaacatcatttaatcatggttttagcccttaaatttttgaaatcaaatcaaattggggaagattagggcttggaatttcaaatgaagattggggatttggaggagcaaatggactccgattttgatgaacttgatatgtacggactcgtggcgagacgaggattccgaaaatgtaagtttcgtaatttttcgagaagcgggcccggggctcgggttttgctagtttcgagattttggctatttctcggttgttttcgattgggtattgtcccattggcattttgtgatgtattcgctctgtttttgcttagattcgacgcgcgaagaggccggattgagaggcaaaggcgtcgcgggtttgagatttcgccggttcgaggtgagtaatgttagtaaatgttgttctgagggtttgaaaccccggactttcacatcgtaacgctatattgaggcatgactcgcaccccatgatatgtgcggagtcgaatattgttggggattgtgacttggtccatcccgagtgagatttatactatattggcgtatgatacgcacactgtgatgattgatatttggcttgattccatgcttggggccttgtgccgacttgtataatccttcagggattgattgatagctgggctttatgccgtgtttggggcctagtgccgacctgtgatatccttcgggagttgatattactgtttatcatgattgcatatcattttatatcagtccatggttttaaaagattgttttacaaacccagccgcattttctaagttttaaaactcatatgttaccttttaaatacatatcagctgaggatcatggtttataaatgcccgagaggcttatgatacattttctggacagattttgggtggctcgggcagcgcgccgcagcggtaattggaaacagtggtaacatggacactgtgtcatatgagccgtcaggtaacatgtgctaacctggttattgattttcgccaccacgagatggctgattattgcgcttgggctgtaggagccccttcggagtctgtatacacccccagtgagcgtcgtcgacgataaatgatatgggtggctcggactgcacgccgcagtgggtactggattgtaccatcatttgcattgcatagcatctctgcatttgcaccttatatatttgttgttcagttgttctgttattgtggtactctgttagttagcttacattgtgcatttactgtgttttcttgccttcggagcttcatttattattattactcactaggtcggagtactcacattactccctgcaccttgtgtgcagattcagggcatgctcaggcggattagatcctgcagcttttcagacatcagcagttcggagcgttgaggtagctgcacggcgttcgcagccatcgaccctcctcccctctatctttatttcctatttttcctgtgtactttcagttgcaaccagatttgtatcagattgagttgttattctagaggctcagacttgtgacacctgttcctaggggatttgctattggtttcagttcattccgctctgtcttttgggatataaatctctttcgtgttgagactattatttctttattgtctttatctgggattattgagattgtggtcgggcttgcctagccttacggccgggcgccatcgcgaccgggtttggggtcgtgacagcctccttcgagtctgtttccacccaatcctggaagtctgccttctcccaatcctggaagtccgcctcctagaagtttggcgtcattttcttcattttttttcttggataacttttctgcacgaacgtaacaatcatgcatatgcatgttaggttgattattagcgacaaattatcaaaaaaacttgttagctacaagagatttggcgacagactagtgacaactttggttgctaatccctattttattcggtagtagtctttttagattagtctagttgttaatagcataagtaaaatgcaaaataaatcaagtcgatccataactaccataaacataagaaaataactccatctttacatttatatgacactgcttgaccagaggcagatacatgatttgaattttatgggttcaagttcagaatactgcctgatcacgcccaactctagtcctaaaaaggataattggtcgctgcaaatataattcagatctaagagtccggagtcgaatctcatagagaactagagtttagctataactgtttactatcactaagaagcactacaacattatgaatctacaactacgaattctttgctacgaataaaaaaagcgtggctattatctagcaatagccataaaaattgaaattccgtggctgttcacaatttggtaaaatttcttagctacaaaaagtaaattggcaaagctaattcctaccttttgctatagttggttagtatcgtgacaataactacgaaaatagctacacatttactgctacattataaatttgtagctaattgttagtttttgccacgcatttaatttattgtagcaaaaataaatatgcagccacaataaattatgtcaaataaaatatcgaatgtatttgcttcagtataaaaatcgtggcaataattggcttaatagctacgatgaatatcacggaaaaataatatagccacgaatttatatagctacaataaatattgttgctaattctaagttttgctatgtatatgaagtcactgtagcaattgtattcttctagccacgatacacttgtttgcacataattccatagctaaaaaaatagtcttgctccaattttcaaaaattgtagcaactattgggatatatgtgctcaggaaaaacctacacgagacaactcaacaaaaaatctattttagaagcttattaaaaattttaacacacaaagagcatctaaaattataaaacttcataatagataatttcttaattggggttttccttatcaagagatatagatacatttgtatctataaaaagaagacaaacatttacacgccttgcgacaattatgaaacaaaactataatgagtaggaagacagaggtttagtcactaattcattaattggaatgaatgcaaggcactttggttgaatttgtaagagtttataaattcaagtgtgaaatttattaaaattcttataatcacatagctattcctaaatcaagtgtcatgcatcgagaatttgtcaacagaaagaacagtcgtttcaactttagcaaccatgtttaagcttcaacaaaatctatttctataaacaactatgctatgtttaacaatatttatttattaatttaatacagaattcatcatagtttcccctgagaattcatcaacgtaacacctggtaggaaaggtcattcaactcaatccaactaaaattatcatgtcaatactattgaatattaactcatattcaatatagagtaattcatcaatataataaagtaatacataaattctttaaaataataaagaactaaacaccgtctctcaaataaataagtaaaagtttaacattacttgaggataaataaatatgcatataaggcttctaaatattttacagtaataaatcttcatcatcaatttcaggttctaattcgatgtcttcaataatatcatcatctaaggtaatattagtgctgataacgtcacgatcatttcttctttgtcacgaccctaattcaccaatcgtgaacacgtcatgacggcacctagtcacgatgactaggtaagcctaacagtgcagaaataacagctaatacgataatattaaatcaagagtcaaataacttaaggaaatgtatattacttgccgcttggcacatacacttcgacactacaaattctgaaatagaaattccaaaatccggaatctcacagaaaccacagactaatggaaatgtaatacactgctctaactccggtatgtctacacaaccgaaagaaaaggaaatcagatactacagctggaataggatacagactcctggtctgcggacgtggcagatatacctcaaagtctctggtagatgtctcctggatcactgatggtgctcctgaccggaagtacctggatctgcatatgaaaaacatgcgcagaaaaagcatgagtacaccacaacggtactcagtaagtgccaagcctaacctcggttgggtagtgatgaggaaggtcagggcctactgaggtaaaaatatataataaggctgacaatagtataacataagcaggattaatgatatacaactatgaattaaatcggattacacaaacagcaattaatacacagaaaataagataacatagagtaaacagctcaataccagtaccaataatgaggatctcccaggataccgtccagtagtccattttctcaatctgtacgaggagctcccgggataccgtcccgtagtccaccgtatgaatatatctgaaggatctcccaggataccgtcctgtagtccattttatcaatctgtacgaggagttcccgggataccgtcccgtagtccaccgtataaatatatctgaatgatctcccaggataccgtcttgtagtctattccatcaatctgtacgaggagcttccgggatactgtcctgtagtccaccgtatgaatatatctgaaggatctcccgggataccgtcccgtagtccaaccatcaatgtgcagggggatctaccgggaatctaacccttagtcccaaaataaatgtgcagggggatctatcgggaatcgaacccgcagtcccaaagtaaacaaacaaggggggaactaccggaatcccacatccgtagtcccaatgtaaatgcacaaccacaatcagagaatattcagaagtgaagtacaacaatacaaagcaatacgtagttctagcctaatatgctccacgtaatgcaattaaggcaaattaagcaaataggcaatttggatcaaccaaacatgcatttctagactagcacgggctataataacaagtagaataaagcaaatacgaaagaaactcagatcaaatattttaagtaataattcgggttttcaacaattagctcaagtacgcgctcgtcacctcacgtacaaggcatttaattaccaatatcacatcctaagggacaaagtcccccacacaaggttagacaagccacttaccttgaacaagtgcaagtcaacctaaaaccatgctcttgccacgagtatctgactccaaatggctcaaatctattcaattaaattgcatattgtaaataataattcaagtaatttattctacaattaaattcctagctaatacgcaaaattatataaaataaccaaaatgcccctcgggccccacgtctcggaaccgggtaaaattttgcattttcaaaaacctcgcactctcacgagtctaaccataccaaatttatacaattcccatatcatttcgaccctcaaagcagtgattctatccaagagggttttctacccttttcaacaaaattctcagattaaataccaaaacttgtaatagattcgagttatacaaccaaaattgagttaagaacacttaccccaatgttttccttgaaaatctctcgaaaaatcgcttcacccgagctcccttggtccaaaaatgttaaaaatggccgaaaccatgaaataaagcttctgcccaggtatttactctacgcgatcgcggaaattgctttgcgatcacaaagaacaacttttctccgcccaaaatttgctcttcgcgattgcggtcaatacttcgcgatcgcggagaacaattccagctcctccggacatccttcagtataatggtcataactttttgcacacaactccgaatgacaaatggtttgatattatggaaactagacacaaagggctataatttcatataatgatcatttcctgactccttatacattgcgagatataagcttccaaattcatccctgtgtattagagacccttcccggacagactatagtgtaactaccataacgttttgtacacaacttcaaattcctattactttacatttctgaaaactagacaccaagggctacaactgttatttttggattatctctaaattccttatagattgtgagatataagcttccaaattgggatcaatgcaacagaaattttcttcttcgcgatcgcgaagcactggcatttttttcgcatttttctcaccgagatcgcgtccaattccccgcgatcgcatagagcactgctgtagccaaaaaccaacagctaaaaatagcttagaaatggtccggaaccaccccgaaactcatccgaagtcccccgggacctcaaccaaacatgccaaccaatcctaaaacatcatttaaacttgttccaatcttcggaacgctcaaaacaacatcaaaacacaaattttacatcggattcaagcctaagaattccaaaaactcttaaattatatttttgatcaaaaagtctatcaaacctcgtccgaatgacctaaaatttttcacacatatccgaaatcacctaacgaagctacagaaacttctggaattctgttccgaccctcggatcaaaatctcacctatcaaccgaaaatcgccaaaatactaattttcggcatttctagcctaaatgagctacggacttccaaaatacattctgaacacgctcccaacctcgaaatcacctaatggagctaacagaaccatcagatttccattccgaggccgtcttcacactgttccaactacagaccattttttaacacttaagctctcatttagggactaagtgtcccaaaacactctgaatcccaacaccgaacgtcccggcaaaccaaaatagtagaaatgaacatagaggaaacagttaataggggaacggggtgtaaattctaaaaatgaccggccggatcgttacattctcccacacttaaacattcgttcgtcctcgagcgagcataaagaacatacctggagtagtgaaaagatgtgggtatcggctgcgcatatcccgctcggtctcccaagtcgcctcctcgaccggctggccccgccattgaacctttactgaagctatatcctttgacctgagctttcggacctgcctgtccaatattgccactggctcctcaacataggacagatccttgtccaattggactgagctgaaatccaacacgtgcgacggatccccgtgatatctccggagcatcaagagatgaaataccggatgaactcctgccaagctgggaggtaaggcaagctcataagcgacctccccaacatgccttaatatttcaaaagggccaataaacctcagactcaacttccctttcttcccaaatctcgtaatgcccttcataggagaaacacgaatcagaaccttctctccaaccatatcggaaccatcacgatctcttcggtccgcataactcttctgtctggacgaggttatacagagtctatcctgaatcactttaaagttttcccaagtattctgaaccaaatttgtgcccaataatctaacctcacccggctcgaaccaaaccacgtgtctctggtgctcataattaacttgctcacagttggggcaccgagctacaaatctgactaggctctaaaaaatccaacctcacaactggctggcaaaggcctgaacatccatcgccattggcctctttgatgctggtaggtaagccaaacttcccaaactctctgcccagcgactccaagcatcatccactacattggattttcccgagtgatacaaattagtgatgtcataatccttccgcaactctaaccacctcccgtggcacaaatttagatccttttgcttgaacatgtgctacaagttcaggtgatcaatataaatctcacaaggcacaccgtacaaataatgacgccagacctttaagtcatgaacaatagcagctaactcaagatcgtggataggataatttttctcatgtaccttcaactgtctggatgcgtaggcaatcaccctaccatcatgcatcaataccgctccaaggccaaacctcgaggcatcgcaatagacagtataagaccttaaacctgtaggcaataccaaaattgggaatgtagtcaaagatgtctttagttttctgaaagctagcctcacactcttccgcccactggaacggagcacgcttctgggtcagtctggtcataggggttacaatcgatgacaacccctccacaaaacaacggtagtaacccgccaagccaaggaaactgcagatctctatagctaaggatggtctgtgccagccttgcactgcttctaccttctttagatccacccaaataccctcactcgataccatgtggcctaagaatgccacggaatacaaccagaactcacattttgaaaactttgcatataatttctttctttcagagtctgaagtactgtcctcaggtgttgctcatgatcttcccgactccgagaatacatcagaatgtcatcaataaggataatgacaaaagtaaagatatggccagaatacactatgcaccaaatgcacaaaagctgttggttcattggtcagcccaaatgacatacaagagactcgcaatgatcatacgaagtcatgaaagaagtcttcgggatatctggctcccgaaccttcaactgatggtaacatgagcgccagtcaatcttagaaaacacctgtgcaccctgaagctagtcaaacagatcatcaatatgaggcaaatgataacggttcttcactatagccttgttcacatggcgataatcaatacacatacgcatggaaccatccttcttcttcacaaataacacaggagcaccccaagtgatacactagggtgaataaaacccttttcaagaaaattcctataactgatccttcaacataactgaaggtttcacctcatccttagtccataaccttaggacaagacccaaactttaacttttaataacgcttaattacttcgaaattgtttttccgggatgttacattctcccacacttagggtcattcattctcaaatacagaacgtaacttatctctttattagcacatcttaatgtctcaatttattttatttttttctattcccaaattttccagaaatgtcggcagagcctcccctgtaattgggcctatccacctgccagagtaacaccaaaataactcctaacaacacatccacaacccaataaaataccacaatgtatatatcaataatactaatctctgcattacaagcatcacattatcataatgatatctggacatgaaacacgtcatctgtatgcccataacctcgtctctggccataatagttgttcataattcacaacatttccaattaaccttatgttaacaaatatctcatttcagacctccgctttactcacaacgaggcatggagatcttataattacttacccgaattaacgagtcacatttaacgccacctgggcgcccatctcgtaggctaaaactcaatgtttacaacacaaaaatgactgaatatgaacaaaaaaaaatatacaagaattgtcaaataagcctaacagacatgactcccatttaaaatatagtacaaaattttaaatttcatagaatgagaattttaatcatataaacttttcactgccaggaccttgtccttatataacatccaccgcggcttctagctcggttcaaaatatttcacattatataaaaatttgaggatctcatcctcaactctgaatcacaagtatttgtacattgtaccaactgaaatctttcatttcctttctttcttcttttcaataaatttccgtcaaagaaaatcacaacaaaacccactataataagtaatagaaagtcacttttagcctcatagatattcttagtgaccaacacatactgatagggatagctatctccatataatagcccagcgtgagtattcacataagtagatttcaagattacgaagctcactcattagtgaagcatattaagaggactcgcctcagttttcaaaaccaaatcaagttaaggaaaaaaatatccttttttataacaatcagaattgtacatgtaatgacaccatctggtgtagtggcctcagccacactatagcaattatatcaatgggtcgggcatccacctctcaggcgccatctacccgttcgttctccatatctaacttgtagcgtatgtagattaataacttcaatagagtgtgttgactatgtattctgatgaaatagatttctcccaagtctgggacaatttctcatgttgtttctagtatcatcacattcataacaacccatctgtagttcggctgctcatactgagtctgtgccggataactagaataaccattgaagaaattccatgccagtggtgcattaaaagatgactgccccatgagagtgccctgattaactggagcactacgagtattctgaaatcgtttccatttccctgttgatacttaaatgtagaattattacggacataggaaaaatcgaaagtcccaacatcatcccatacaaatctcaactcttactcatatacaagtttcagagaacttttgaataccacataaatacatctcaggtcaaatctgatatgacacatgacctacaatttgatcgttgatagtggactctcttcactttggtggccataagatacatcccgatactccacaatactaacctttatcgctcgtacatcatcgtcatgagatacctcaaccgttcgtttgtcacatgtcattcttaggacagttaaactcacttcctccagtatctcggttgctagttgtacccttcgctaaatagacatctcatatgaaccacgtggccactattaccaccaactatacttagatctacatccacctcgcgactctaccagtactgtgacgattaggcaattaagtaaaaccttcttaagaccgtaattatcaaccagatgtcagaacctattgcactcccatgtgcacaattgaatgatctctcaatatttctacattatagatatggatgacacgtggtaacaatggttgagcaaattcttggctcctttgaaatccttctgtagcatcacgaaccgtcggcacataattgatatcgagtgcgcagtttcaatacacgagtggattcaaaaagacatatgatataggctccaactgaataaatgacgcacgataaggaatgaaattaagtggaatttttctaacggttacatagcctctcgtagataagtacagatgtctccgtaccgatcagcgagactctaataaaccggcctgtgatccgtgactcctatgaacctagagctctgataccaacttgtcacgaccctaattcaccaatcgtgaacatgtcatgacggcacctagtcacgatgactaggtaagcctaacagtgcaaaaataaaaactaatacgataatattaaatcaagagtcaaataacttaaggaaatgtatattacttgccgcttggcacatacacttcgacactacaaattctgaaatagaaatcccaaaacctggaatctcacggaaaccacaggcttatagaaatgtaatacactactctaactcctgtatgtctacacaatcgaaagaaaaggaaatcagatactacagctggaataggatagagactcctggtttgcggacgtggcagatatacctcaaagtctctggtagatgtctcctggatcactgatggtgcgcctgaccggaagtacctggatctgcacatgaaaaacatgcgcaaaagaggcaggagtacaccacaacggtactcagtaagtgccaagcctaacctcggttgggtagtgacgaggaaggtcagggccctacagaggtaaaaatatataataaggctgacaacagtataacataagcgggattaatgatatacaactatgaattaaatcggattacacaaacaacaattattacacagaaaataagataacacagagtaaacagcttaataccagtaccaataatgaggatctcccaggataccgtcatgtagtctattttctcaatctgtatgaggagctcccgggataccgtcccgtagtccaccgtatgaatatatctgaaggatctcccaggataccgtcctgtagtccattttattaatctgtacgatgagctcccgggataccgtcccgtagcccaccgtatgaatatatctgaaggatctcccaggataccgtcctgtagtccattccatcaatctgtacgaggagctcccgtgatactatcccgtagtccaccgtatgaatatatctgaaggatctcccgggataccgtcccgtagtccaaccatcaatgtgcagggggatctaccgggaatctaacccttagtcccaaaataaatgtgcagggggatctatcgggaatcgaacccgcagtccaaatgtaaacaatcaagcagggagctaccggaatcccacatcagtagtcccaatgtaaatgcgcaaccacaatcagagaatattcagaagtgaagtacagcaatacaaagcaacacgtagttctagcctaacatgctccacgtaatgcaattaaggcaaattaagcaaataggcaatttggataaaccaaacatgcttttctagactagcacaggttataatgacaagtagaataaagcaaatacgaaagaaactcagttcaaatattttaagtaataattcgggtttttagcaattagctcaagtacgcgctcgtcacctcacgtacaaggcattcaattaccaaatatcacatcctaagggacaaagtcccccacacaaggttagagaagccacttatctcgaacaagtgcaagttaacctgaaaccatgctcttgccacgagtatccgactccaaatagctcaaatctattcaattaaattgcatattgtaaataataattcaagtaatttattctacaattaaactctaagctaatacgcgaaattatataaaatgaccaaaatgcccctcgggccccacgtctcggaaccaggtaaaatttacatttccaaaaatctcgcactctcacgagtctaaccataccaaatttatacaattcccatatcatttcttccctcaaatcagtgattctatccaagaggattttctaccattttcaacaaaattctaagattaaacactaaaacttgtaataaattcaagttatacaaccaaaattgcattaagaacacttaccctaatattttccttgaaaatctctcgaaaaatcacttcacccgagctcccttggtccaaaaatgttaaaaatggctgaaaccatgaaataaagcttctgcccaggtatttactcttcgcgatcgcgaaaattgctttgcgatcacaaagaacaacttttctccgcccaaaatttgctcttcgcgatcgcggtcaatacttcacgatcgcggagaacaattccagctcctccggacagccttcagtataatggtcataactttttgcacacaactccgaatgacaaatggtttgatgttatggaaactattcacaaagggctatacttccatatgttgatcatttcctgaatccttatatattgcgagatataagcttccaaattcatccctgtgtattagagacccttcccagatagcctatggtgtaactaacatatctttttgtacacaactttaaattcctattacgttacatttctgaaaactagacaccaagggcaacaactttcttttttggattatctctaaattccttatagattgtgagatataagcttccaaaatgggatcaatgcaacagaaattttcttcttcgcgatcgcgaagcactgtacgcgatcgcgaagcactggcatttttttcgcattttagtcactgcgatcgcgtccaattccccgcgatcgcatagagcgcttctgtagccaaaaaccagcagctaaaaatggcttagaaatggtccggaaccaccccgaaactcatccgaggtcccccgggacctcaaccaaacatgccaaccaatcctaaaacatcattcaaacttgttccaatcttcggaatgctcaaaacaacatcaaaacacaaattttacatcggattcaagcctaagaattccaaaaactctcaaattacattttcgatcaaaaagtctatcaaacctcgtccaaatgacctgaaattttgcacacatatcccaaatcacctaacgaagctacagaaacttccagaattctgtttcgacccttgataactgtgaattgtacatgaattatgcccctctcttaccttagctttgcgcttaatttgcctctcattagtcccaaaactcttacaaatgcgcttgattgcaggtttgagcgacaagatgatatagatcacaaatcagctcaaaaaggagtgaaaccggccaaccgacgagagttgatgaaaagatggaaatcaaagtcccatgcggaccgcaccattctggtgtgcggcggcacaacattaatcagagaggatgaacaacttcaaggaatccatgagggccgcaccacattggcatgcggccgcatgatgatctatcagagagatgcaattttttggaatcaacttagtgcgaccgcacccattttgttgcggtccgcctgctcaaggaaggaaaaagaggacctctcagacaaggccccatgcggccgcatgacacttttgtgcgggccgcatggtcaaatttcagagaagggagaatttggaaaaggcttaaggtgtggccgcacagcattttggtgcgggccgcactcctaaccctatgcggccgcactccatttttgtgcggtccgcacctctctacccaagcagctgaagacctgaagacctatcccttgagcggccgcacgccacttttgtgcggcccgcatctgaccctcaggggtatttttgtccagattttactgtgtagtataaatagaacattttacttttttaggttaagttttatgctctgaaccagcagctgagctcgtgagccatagttttagcatactttaggaaatttcttgtgtattcaaagtggattcaagtagttttaccttttaattaatgattatgtctttcttttctactatttctgtagtttctacttcttccatgtctagctaaacccattagctagggttgtggctcaaccctagtgtgggtaattaatgggtgtttgtgcttgattcgtggatgttggttgggtgtttggatttgggttgtgtgtatgcttttactttgatttggtggttgcaaacactaagtcaagcttagtgggttttgactcttcttgagaaagagagtctatagcctcaccctcaacccaacaaggatttgggatggacccatgataatggtagtcccaagtaataggttaaatctcgagagagtaattaccttacttgaaccttgagttgcttaggcaaattagcctacccaattggtctcgagagagtcaattgggcaaaatcgttctctctaccgagaggtgtgagagcgagtactatagtgcaacggttatccatattccccatacttaacatcctcgggttagaatcttatacccgttaattatccgcctaggtaagtgtcacgaccctagtgcctttctctcttatttgcataaatctaatattagaataatttagcataattctagatttacatagtagttaatcattttagatattaatacttgaaaaacctaaaagatgttagaagaccaattagaagctagaacatacttctaggccatacatttactcatctccaaattgaagctccctgtggaattatcgaccccgatacactattgggtattagtattcgagcccgctcattcttcggattgagtttgccacgatcaaccctcgggtcaaaatctcacctatcaaccggaaattgccaaaatactaactttcggcatttctagcaatggtccggaaccaccccgaaactcatccgaggtcccccgggacctcaaccaaacttgccaaccaatcctacaacatcattcaaacttgttccaatcttcgtaatgctcaaaacagcatcaaaacacaaattttacatatgattcaagcctaaaatttccaaaaactctcaaattacattttcgatcaaaaagtctatcaaacctcgtccgaatgacccgaaattttgcacacatatcccaaatcacccaacgaagctacaaaaacttggggaattttttccgaccctcagatcaaaatctcacctatcaaccggaaatcgcaaaaatactaactttcggcatttctagcctaaatgagctacggacttccaaaatacattccgaacatgctcccaacctcgaaatcacctaacagagctaacagaaccatcgaatttccatttcgaggccgtcttcacactgttccaactacagaccatttttcaacacttaagctctcatttagggactaagtgtcccaaaacactctgaatcccaacaccgaacgtcccggcaaaccaaaataatagaaatgaacttagaggaagcagttaataggggaacagggtgtaaattctaaaaacgaccggccgggtcgttacattctccagttcataaagtcttcatcttcctcaaacgtacacgagaactcttgagcattttgttgaaaagtttcttcattgagagcaccaccagtaaaataagtagaatgaccattcaagaaaatgaaccaattgggatgaagattatccttgacataaaaaaattgttctgcttgagatgcaagcacaaacggttcatttgttgctagctttcgtttagtattgacactaacaaagacatgtttatctatcttcactccttttccaatgtgatcaatatccaaccaatcacatttaaagaaaacaatctgtttaccttcaagttattgaagttgtactattacggtcagagtaccataataatttatattttggccattcattattcctcgtactaaaacaccactattttgcttcatcccgtttccttcgagttgtttagtatgaaatctaaaaccatttatctcataccctttgaatctttggattccatcaaaaggacctctagccaaagaatacaacttgcaacttacttgtgaatttcctttcttgcgcatttgcacaatctgtataatagtaaataaataaaataatgatgctaaagaagtattacaaataaaaattaacaatgtaatgaaaacttactcgatggaaaaaccaatcgtcgaagttcatgttcctattattctgctcgtattcactctcgtactcactgtttaaaatcataataattgagaaaaggcttacaaaatcaagcagagatgtacaatggaataaagaaacataccataaaaatgattgaacttcttcacaatttctcaaaacataaagatgagcttgttttcgctcaagctctttaagatttctagatgtatctcctaataaagggcaacccttttgttcaaaaattaaaaatctaccgaatggctcaacctgatcaccttcacaatttttgtccactggattattctctttcccacttccatgtaaataccttgaacgaaatatcagactttcttcaataatatatccttcagcaatagatccctcaggtcgacatctattacgaacataacatttcaatttgcgcaagaacctacatgatgatgatgatgatgatgataataataataataataacaacaacaacaacaataataataataataataataataataataataataataataataataataggcagttaaaatgcctagcatgataaattaataaaccataataaattgaaattatgaaatataaaaatataccgctctattgggtacatccacgtgtattgtacaggcccaacaatcttagcctctcttggaagatgatgaccaagtgcaccataatatcaaaaaatattggtaggaatattttttctaatttgctcaattgtaacgacccgactttggtcgttttactgtttagaaccccgctcccttaaataaaactttctgtgcttttcttagcttaattatgacttgcggtggtgattagttcggaagttagaagagttttgagtgaaaataaaataaattattccttaaggatttcttaagaaggccaagtttgacttcggtcaactttcttggaaaacggacccgaattcgtggtttgatggtcccgaagggtccatgggaaaatatgggacctgggcatatgctcggaatcgaattcctaggtccctagcccgagtaatgaatttttatataaaattattaaatcgaagttttaaagaattaaaatacctaagtattcattagaaacctaggtatcgggtttggatttcggttccgaaacttggtataagtccgtaatatcagttaagacctacccgtaaagtttggtgtcaatcctagaaggttaagggcattttgacccgttgaaaggaaattaagaacttgaagttcaataagttgattcaattggttttggggttcgattccttgatttagcattgtttcgtgtgttccgagggttcgagtaggtctgcctcgtaatttcagacttgtcggtgtgttcgggcggggctcggggggccccgagtgtcaaatagtcgaggttcgagcgaagttggaatttaaaaaggaaccatttctgctgcttttgtcataaccgcttctgcggctcttggaccgcagaaacggtcgaatctccgcagaagcgaaaaaggggccaggcctgggaaaccgcaaaagcggcccagaagctgcagaagcggttccgcctctgcgacccctggaccgcagaaacggtccggcccagccttcctaatttccgcagaagcggccttctttacgcctttgcgggaccgcagaagcgatcctattgaccgcagaagcgaaaatagctgggcagaagggttcatttaattcgaacccaaagccatttctctcatttctcattcaattcttgggcgattttggtgtttccaaagagggagtttcaacataacatcacaaggtgagtaatccccactcattcttagtttaaatacacgaacattagatagatttaatactaataatcaaataaaaatcaagggttagagctagacctagggttttgataaaattaagatttaaccacctaattagctacgtaatgaactaaaaatcacatattagtaatccttaggttatagagaataattttcttcgaaaaatctcggaatccggctacgtgggcccggggtcggaatttaggaaacttgcgggaaaggttggaaaatcacttgaattaggtagaattcaactttgtgagcacttattgactagttcttgctttatttaactagttggtgctcgtttggcttcgaattaaggttggagactattcttgatattgaaagaatgcttcggagcgaggtgagtctcctttctaaccttgtaagagggaaatgtccccataggattaataaaatatgtaattattgctaaatgcgggagctacgtacgcacaaaggtgacgagagtccgtacgtagctactaccattttgattgtccgggtagtttagaacccacatcatgctttatctacgaatatctatatatcatcatgctaatgtgatcgcctaggatatattagaggcttgaaggagaataaaagtaacttgtacacttgttgaactcttgtatggcataattgaatatttattaccttcgtgtgtattcttgatgcttgcttgttatttgtggatcgggccgatcgcctcgatatgaataaatgcatctataggcgcgtcgtcgaccctcggcaagtgcacatttcattatgttggttcgggccgtcgcttcggtataatgtgcgcatgattattacgtagaaacttgtactcacattgcttgtatttatacattggatatggaatttgtaaatcgtgatattgtaaagacatgactcatctctcttgccctaaacatgttgatactagtagcttccatgcttataaatattctcatatattatttgaccttagtaagtatcaagtcgacctctcgtctctacttcttcgagattagacgggatacttactgggtacatgttgtttatgtactcatgctacgcttctgtacttaaatgtacagggtctgaggcaggtggatctggttaccattcgggcgcgcatcagtgagccatcttggacttttacggtgagctgcctcctttcattgacgatctgcagccgaagaagtcatctctgtacttttgtttctgtctatcctgattcagacagtaggatagcatattattcttttatatattctctactagttgcccgtagctgtgacaccaggttctggcacacactttagtagactagttttgggttgtaatattatgtctttacatttattactgtattgggtttatgaaaaccccttttgggatgcttatccccttcttaaagatgttgatgttattaaacttagaaatattttccgcacttggcttgcccggcaaggttgttgggcgccatcatgacctgttatggaaatgggtcgtgacatcaatgttattggaatttgagctgcaagctgatctaacacatcaactcttacttttttttaacataactccctaaagaaaatacttagctcagtaatagcagcatagacatcgctcggcacaactccgcgtattgcaaaaggaagcagctgttccaaaagtatatgagaatcatgactcttcagcccataaattttacaatcctttaactttgcgcaccgtgatagattcgaagaaatgcatctggaaccttaatatttttcaaaaacttgcatactttaaacttctcatctggtgataaattatagcatgctgctggataataccatgttccatttctttgagttgaatgcaaatctctttttatacccattttcttcaacttacgacgagcattcagattatcttttgttttttcttccatatctaataacgtcccaataatattgtcacacacatttttttcaatgtgcatgacatctaaattgtgaagtattaaattattttttcaataaggaagtctgaaaaaagatgcttttcttcctccagttatgagtggatttactctttccgtgcctttatttcttctgggtcttaccaaatttaatgccttccaagatagcaaactgatttaaaatatcatcaccggagagaatttcaggaggaggtcttctttctactttcccattaaaatcatgtttattaccccgccatttatgattagatgataaaaatctacgagcaaccatgtaagagaacttacgaccatatcttagacgagtagatggagtctctttattgcatgaagggcaagccaaagctccttttgcgctccatccagacaagtatgcatatgctggaaaatcatttatagttcataaaagtgcagcccgcatacaaaagttctcctttcttgaagcgtcatatgtattgactccattataccacaattcttgtaattcatctatcaaaggttctaagtagatatcgatgtcattttcaggagctttaggaccaggtatcaacaaagataggaagcaataaagttacttcatgcacatccaagggggtaagttatatacactaagaatcaccggccaattgcgatgagaaatacttaaattgccaagaggatttatcccgtcagatgctaatccaagtctaacattacgaggatctctagcaaattccgaattatatgtatcaaaatgtttccatgcatcagagtcagctggatgtctaagaaccccatctttcaaacgccaattatgatgccatgtcatgtctgaagctatttctgatgacataaacaacctttgcaatcttggtttcaaggggatgtaacgtagaacttttcgaggaactttcttctcaatctttcctaaagtaacctcattagctttttgaccttcacttgatttccacctagactcaccacaaaccaagcaagattttgcttttgcattatgtttccaaaataacatacaatcattttcacaagcatgtattttttcataacgaaggcctaaatttcgaatcaatttttttgctccataaaatgattctggtaaagtttcaccagaaggaagtgctcgcttaattaaactcaatatgctatcagttgctttatcactcaacccaaaaagacacttaatttggaacagttccacaactagtgacaacttggagaattgctcgcaaccaggataaagttgttgtgcagcatctgccaacaatttggaaaattcagaagcaggttccgaagtatcaacatgttttctcttaaccccactagaataatccatgatatttgggccagcagcatcataactcatttcaaatatatcatcaccttgctttttcttacttcctcttgtcttatttcattattgtcggtgttttgctctttaggtgcaaattctccatgataaagccaatgagtgtaccccttgactatcccaaaaattattaaacgttccccgacttcatctctagtcttatggaaaacatagttgcatttcttacaaggagaaggaatttcaccttctagttttgtgtgttcaaaagcaaattgaagaaaatcctcaactccttttaaatatacattgctcaatctatctgtacaacacatcaaagttttgtccatttcaaatttcctacaaagaaaaaaataagatcaatatacatcaaaagaaaaatattccagattttcaagagttaagcacaactgcaaatggaaaaaaatttaaaaatacacaaaaagtatagctaaatgcctctcaactatcttttaacataagaaactattatggattatatcataacatgtcaattaacaccaaccaaatctaaaagaggacgaacaaagtggatcaaacttcagccatggcaagatccaaagtggccaaatcacacttttctcggttcgaagattttcagtgtggttgctatgttgataatactactagctccacttcaagttctaacaagcaataatgattcaatgactcactgcaaatgtattttcaacaaaatgctgtatccttcattctactgttatataaaataacattacctgccctaatcagttctaatttaaagaaaggcaagagaaaaatgacaaagccaacaacttgctacaatgtgtcattccttcaatttaaatgttttcagatgattttgtgcaaggaagtaaaagtgcgaatgtctttatcacgttcaagttcgtacatgtctttctcattcaaacacacccatgcttcaattccatcaccacatttgttatctaacagagtgatcatttcacagcagcgacgtgcactgctacccaagaaggccttttccaaccaaagtcagcgtcatatgctggtaacttactccaactgggacatataaatgcatcaacgctgctgtttttcaaaatccttcttgttcctctttaaaatttatagcttagcacaaagagattgtcacgaaccaagttcgacctccgtgagctgtcgtgacggcacctagtctctacgactaggtaagcctaaaaatttcagaaaagaaaacaacagaataaaactagccaaaactgtagaaaaatataaaaataaagcgtttaagatgccgcacagcatatacaatataactctcaaactgaaactacattttccaaaatccggaatctcatgaaatcacaagctattgaataactacaagtgtctaactccagaatgtctaaacaaaagtaaatatagaagggttgatattataagggagagtagaaagggactcctcggcctgcggacacggaagatatacctcgaagtctctagagaatcgcctcgcctcaagggtagtagggctgagccgaagtacctggatcttcacatgaaaaacatgcgcagaaagggcatgagtacaccacagcggtactcagtaagtgccaagcctaacctcgatcgagtagtggcgaggaaggtcagggccctctgagtttaaatgaaaaacaaggtataacagtattgaataagacagtataattaaatgcaacagtaagaagtaacgcatgatagaaaggacaacaataactacaacagagacaaaataatcacagaaaggaatacagctcaatacagagataacaatcggggatctcctaggataccgtcttgtagtcccaattataaatatccagtggatctcccgggataccgtcccgagtccaactcataatgcgcggggatctcccggaatacctatccgtagtcccaaatgtaaatatccagtgctgggggaatataccagatgcagtcccgtagttccaatgtaaaagtgcagggggatctgccggaatacaaatccgtagtcccaaagtaaacatgcagggggatctcccgggataccgtcccgtagtcccaaagtaaacaaatagcagcaacacgaagaacactcaattcaattccaatttcataccaaggtaaaataggtatttctaacctatcatactacacagaatttaaataaggcaatttgagcaaataaagtaattacgtcaattaggcatgctttcctaagctaacagtaagcttaaattgcaagtagtttagacaggaaaagaagcacaattatagttaattaatgaaaacaggattttcaacaattcgcacaagtacgcactcgtcacctcacgtacaaggcatttcaaatatcaacaacaccaaatcctaaggggagttttcccacacaaggttaggcaagccacttacctcgaatcgactccaaatcaacctgaaaccatgcccttgtcacgagtactcgactccaaatggaccaataatttatgggtgtgcattgtccccaatgcacatccataaatacaaaagggtaaaagaacctctctggtaggccaaaggccgaagcattagcagctcatggggtactcagacttctctcatacttgattttttgtgcgggcaccccacacttagttctaaccaattcacttacttttgttttcttctaatggcatttcttcccatgctcttagagaattaaaaaataaaactacaagaataatacaataataaaaaaataattaaaataaaaataacagaaatcagtaaagttgggttgcctcccaacaagcgcttgatttaacgtcgcggcacgacgtgaatcactttttgcctctacctcgagctgatgaattgagccccaaattttgattcaagcttatgattatgctcatggggcgatacaaattattgcgagctaaaaatcaaatgattctttatgcacttttttgctttcaaccggggagtgtcagtttacctagacggccgtgaaaatttcagaatatagggcccatctatgtctacctttgactcttgcattggctcatacaaatcaatttccatatctccttcttaacacaatctcaaaaaatgtttggagtgaggatgaatgcgctcaaactgaaaattcaacttgttatcgacctcctcttcttgccacaaactagaatcaattaaaattgtatatgtaaagtcctcagttgactccagtaccacttcttcaacatcgacatgatcacattctagttggttggttttgtcgtattctactctcaactcatccattataatggcaatttctgtcgctaattcatcctcttcttggctactatccataatgtcagcttattgtgctttacaaggttcagctatttgactcacttgagcctttaaatttcgaatagttccctcttgcctttgtatccacagtggtttctcatcatattattccacaaggcacttaaaaatatacatgatcttcttcaggtcagcattcctaggttattttttcctattaacttcacaagaaaaagtaaaaaccatcatcataaggagttgggggaggataaggaagatcaaaaatagaattaccaattgaaattttcataattcgaagatgtcatatttccctaatcaacaagtaaaaaaaatcaaatactagaaaacaaaatacaagtttaaacttgaaacctagcaatatgtacgcctataactacactggtagttccctgataatggcgtcaaaatttgatcatgcccaactctattcctaaaaagaataagcggtcactaccaatataatctggtctaagagtccagagtcgaatcccacagagacaagattaaggaggtctagagttatgatttccccaattgtcggaatccttcccgctatgttttctataaattcgcataagtattctctatcgatcgtgagtactttgggtgtcgtagttatctctcgagcaactataacaatttattagatgtattctctcgaactacactagctggcgttaattcaccgttcactacgatcgcaccaagattttattatctctaatcccgcttttaaaccctccgtattgatctttcacatatgttaggagtgatgttgtttaacaactacctaaatgtgtaccctctctcaagcaataaatactaaataggcgcagtcaattgatggtcattcaatcaacagcaacaaacacgtagttgaacaagttgagaagtccaacggctcaattatataataatataacaagcattcatcctccagaaagttctataaaaatcctagataacaaacgagatattcataatggtatacaaaactaaaatactagaattcataaccaataatggaaatagaggaagaaagaggaaagaaaaatgtgaagttgaatccttctccttcttgctcctagcgtgttcttgcctccccaaagtcttctctccttcaaaagtagtgtctcccctcaaaagcatatttttgatgtatttatagcgactagggtttgtatggggcgaatttccttcttctatttcggattgcagaagctgttttcttctgcttcggtccgggtctggcaaagtgacctcgcttcgctatccaggacttttctcttcagttttttttttcaccaatttttcatctatttgatcctttccgcataagtttgttcctacacataagaaacacgtaatgggcatatttttatttcaaaagcagtgtaagctcccgcaactcatagaagaaatgacacacaaatacattcaaaacatgcacttttcatcttttattactaccaaactcatttaatttactatgggttcgaaattaattatttgtatttgtttagtgaattatttaacacatatacaaggtcctggacaaagctacatggtttataatctcatataattcacaatctaggtttgccactttgtttgacttacacacgaagttcaagaagaagacaaaaaagactttagacacataccaaaagtacatttagaacttgtggtattaaaatggcataacactattatagcaattagcacgcctttaatattaaaatgaaaaattaaaagttgaaaaatatcattatttttggaattgactaaagaagaaacattgtcttataatataagagaagggagtacatatatgctaagaatccctttgactgagggaaaacacacacattcatacacaaatgagaaaatggccaactaattgaatacctttatactttctccgtttcaatttatgtaaatttatttgactggacataaagcttaagaagaaaaaaaaaaagaaattttttgaacatatattttgtatggtataaattattgcataaagataaattattttcaaatatgaaaatggatcattcttttggcacggactaaaaggaaaacagattcacataaattgaaactgcgggagtacgaattatgatgatgaaggaaacgcatatgttcatggcgcatgaataacaacaatatatagtaagtgctatattctacaagaaaaatgctcattagcgacggaaattctgtccctaaaaataatagtaacaagaaagtctgatccccacccgtcgttatagactccgccgcaaaaaaatcaataagtggatgtttcctaactagtgccctacagggttttactgaccagtggtatactaatctagcacaagttacctaataatttaaacaattggtttaaatgataaattaaactcttgaaatgtatcaaataatagctgctggctacattgttcatatcttcagcaaaaataaaaggaaaaaggaacattgttttgtaacaacccgaattactcaacacaacgctaaggtattttatacgacaaggatctaaataactgaaaaattgcaattctagaatgtaaaaacaaaaggagttatagaactactgaagaaatatgataggtaattagaaaggggattaggaattagacagaatcagaagaggaggtgaggagcacagactttgcctaagcataatcacaattgcataaatcctgaaaccgtaggccactctccttttaaatcattgtcacgtctttccctactccacctggatcctaaacggatctcttgttgggttgtcttgtccttgggcttctttccggtctagaccctggcccaacagcttggccaacctctgtccaaataactggcccacaaatattgtctaaattatttctgttcacaaacagtccatagaagctaaccattattattcatataagtggtggagctctcagccaaatccctagctacgacatctgaggttatcacaagaaaaatggccaaagcaaggctatgttattacttataactactagtacttgagttgtgataacttagaatgaataaattttcactatttatagtatcattatacctgaactttttaggggcgaatgttagaaatttaccgcctcttctagagatttctattgtggcccacatataaggtaataaattatttaccttgtcttccaaaagaaataatatatcagataatattatgtagttatgcatatatgatagtttctttgatggaaagaaataatttttattaggagtccttagggcaattgtaatttttgaaaaagtccctcgggataaagtatttgcttaagagtccctaacctgcctataacacctgtgactcgaaggctcctaaatttttcatcaaagttttccaaagcgattctacaacacttgaactactatggctaaaggtatgttccttatttaatttccgctgaggtggctatgtgtatgtgttcgaatttcaatagcgaaactaatattaatggaattagtcgaataccgaacaagttatatattacgttggcagctaaatatagattgcttagactcgactttttcattacacctatagcgtgctttctattaaggcaaaatagcctcgtaggcacttgtacttgttatcgtttgtcatcccggtccctatactcaaagaacattcatccagacacttatagttgttcaaactcaatgttttaaacccctctgaccattgaccaagtctatgtggcaatttaattgctgaactggacaaaatcgtgtatttcacgcacataaggagcgtgaacgtaaaaaaattatgattaaaataaggaaaatagaaaaagaaaaatgcaaaaaatcaaattagaaaagaaaagaaaaggccaaataggtgatttttctctttctcttacgttctgtcgcccaccaaggacccccccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaggcccccccccccccccacccctctttctctatctccctcccttcttcactttgctcctcttcacccattttatcccaaaacccacagcaacagtacccttcccaccatatcttcatccaaacaatgacatccctcgtcgctatagatccaaaacatctaccagatttgcatcaatttttggggagtttttttccctcacatccccatttcctactttggaagatagcctttgcaaagaaaagaaatagaaatagtgaaagaagatcgccagtgactattttctagttttcctgtagtgaaattttaaaaagttttgggtgatattggtctttcgggtggtcattattgatggtcggtctagcttttggtggttaactggtgatgctatggtggaatgttggctgtgaagaagctttgtaggtgaaggatggtcgaagagggggtcgcacacagttacggataggagttttttaagatttgtgaatgcagaataaaaatggtgagggaggaggaagatggagtaaatggtagaataaaaaaaaggaaatgaacaattttaaaataatgtgaaaaataaattaataatgatgtgtaacaaaaaatttgactgggccactgatgtgtcatccatgtcagaaatttgaagaacacgtgaggtgagaggggtttaaaatattggctttgaacaattataagtgtctcgatgaatcttctttgaatatagggaccgggatgacaaacgctaacaagtacaagtgcctacaaggctattctgccttttattaaatttattttggtttctcacccaaggctttatacccacggctcgaatacataggcgaatccaggatttaaaatttatgagtttattaattatatttttaaagttatgggttcatatatattatttttgtaatccaaaattctcatggtgttccagttgagtatgcaatcaagattcactatttaagtagaacaaaaaaaacccataaaagttgaattttgtaaagccacaaaaattaatccttttatcttcatctgagcaatggtagccaccgttatttttcagcttcattatgttagtgagaccaaaggtgctccactttatcaaacttaagggattaaagatgatcgtatatatatttgaagaacaaaaataaacctacactcataaataagggataattttagccaaaaactcaaacttttacataaaaattttatttcgggtcgaaaattatgggtttaattaaaaccggcactagcacacacatctgcccctgctcgaacccgagacctcaaattaaggagggaggaatggttaccgtaccaccacaatttttggtgtttaatttctttctattaaataactgttgtatttttcttcagggcgatgtatatctggttcagaatggaacatatcatgctattaatttgcatttatctatcagcaaacatttttcgtctttcatttaatatattttttccatcggaaaacctaacctagtgtcttaagagttatttttgtatttcctgaatatattactttaagggcatcttatatttttcatagaagtactgttgtgttactagtcttagcaatttacacattaaaacacacacacacacttagaaaatactatagtttttgggtctagtacattcgtaagtggtgctagctaataaactggcgcattagttagtctaaccctaaatactaacagtaacctatataaacactattataggtattgaatagatataatatggctaggatttttttttttcaaatttggggattttgcatggacccctgccatatgtattaaataaagggaaaatttcacataagaacaactagaatccctacttttcaattttatagcctatatttcaatttacaatcaaccagctcaaaaataataggctaagattcaacatccaactccaataggttctcaaaattactatttaatttttaaaaaagattgctcaagcttttaagttaattttcgaatcactgtaacccaaatattagttcaacaaaccaaatgcattgggatggtaaaaattagatttttaacaagcttaaatatgtggatttagatttcgaatttgattttgtgagaaatttggaatgggtattatctagaattgttagaaatagtataaggaggttgtatataaaatttgaagtcatttaatggagatttggactgattttgaacaagaattgcaactgaaaatcgtggaagaagttcgtctacaaacgcttgtataaaggtgtgacgacccaaagggtcatcatttgttttcttagtcatttcgagctttagaggccttgcaaacctccttataggttgcctcgatttgcgtgcacagtccgggcgcgaagccggaaaatttatatgttgaaatacttgaattatgtgtttaaaatgatgaatttcaagtataatattgatatagttgacttcggtcaacatttttggtaaacgggctcggacccgtgacttgaaaatttctgtagaaccgtcatgaaatttgggactcgtgcatatgtccggaatcgaattccgaggtcccaagcccaagatatgggaatttttgtaaaactagcttttgaaattttcttaaatatttgaaaataattaattgatggttgaatgtcgtatcgggctcgtattttggttccgacgcccggtacaggtcatatatggcgtttaagcgctacctgtgaaatttggttgaattcggacgtcgtttgacgtgtttcagactaaaagaggctaatttgaaagtttgaagttgaagtttggaatttatggattttgagggtcgattctatgtttttgatgttattttagcgatttgatcgcacgagcaagttcgtaggatgattttgagtcaatgtgcatatttggtttggagccccgagggctcgggagtatttttggaggtggttcgggttgtttttggacttagaaatctggtgttttgctgtctgctgctgcccagttattccttctatgcgatcgcataggtgtgttgcgatcgcatagagtaaagtccaagggcccagaaatccttctatgcgatcgcattactcctccgcgatcgcatagagtaaatcccatggtgccagaaatccttctatgcgatcgcattactcctccgcgatcgcatagagtaaatgttgagtccccaggatttcttctatgcgatcgcattgctcttacgcgatcgcatagagcaaatttcagcccctctaattttcttctatgcgatcgcatcaaggccctgcgatcgcatagagcaatttttctgcccagcgatttaagtcacaaaacagaacagaaacgagattttcatcccatttcacaactctctcatcttcaacagctcccataggcgattcttggtcatttcttcatcaaagttcttgggtaagtgttctttaactcgttttcttcatttcccttcttcataaatcaaaatcttaggcctaaattcatggaaatgagtagaaaattagaaaaatccttatagttagggttttcaaataaattgcgatctagacctcgttttggggtcgaatatgagaacaaattatatatttgtactcgtggatgaatgggttgtcggaaatcggttcgaacctcgagttttggccacgtgggcccggggtcgtttttcactattcatggcagaatagtatgaattgtatttttggcaatttggaatattttgttgagtagatattgatgatattaaatcaattatgtatagatataattgatttggaggcgaattctaaaggaaagggcatagcttaaggattgagattgccgtattcgcacgaggtaagtgtttgatctatcctagcttgagggaataggagttgcgtctatttgctatgtgtagagtccgacgtatgggcatggtgacgagtatccatatgttgggggtcttgcatgaccgtgagtctctattatgcttatttgatatcgatgcaacttttccacattttaatttttgatttattcataatgtggatttcgtgaaagatgaattgaaatgatgattgttatggagcgttggctcaattgatgaaattggaaattcattaaaagtgaatagaaatgaaaaggggatttttatgttgccttggtggaacaattatggtattctccttatggagatattttatgctatttgcattattgttttccttcgccctgaattactttgaatatttaattggcgaggaagagtgattaaagcacgaaggatgatgccgtgccttgttataaatgattatgcacgaaggataatgccgtgccttattataatttattatgcacgaaggataatgccgtgctttgatatgagagtgtgggaggaaaagcacgaaggttgttgccgtgtatttcatatgcttgtattggtgaggacgagagaaaaagcacgaaggttgatgccgtgcagatattgatttacttgtcctctttactattattctcccatttttatgtttatatcctgtcattatatattgttgttatcccagagcatgattcccttcccggatattaaatgctatttttctgtgaattgtggtatatatttatgaactgtacaggtttatgtgagtgtctggtcctagccttgtcacttacttcgccgggataggccgggcacttaccagcacatggggtcggttgtgctgatactacactctgtgctcttttgcacagatacaggttttggacagcagcaacagcagcagcagtagtagttcaggcttgtctgttggatatctggagataccgaggtagtcttgcaggcgtccgcaggacccggtgttttcttctatttttcttcagtctgttatctcatgtattcgagacaaacagtattatatttctttcagaccatgatgtgtattattcttagaagttcgtgagtattgtgacaccagtcttgggtagtagtttatgttgagatttcagtactgcgtccagtagttttattaagtcttccgctactttttttttataccttgttattcgtattattattccgtataggagtttgggtgttctctgacaggtggtgttaggcccaaattgcagaggagactctgtcaaaatttttataaaataaatgttgttaattggattataagtagagttggcttgcctagctcctactagtaggcgccatcatgaccccgatggtggaaaatccgggtcgtgacaagttggtatcagagcgactaggttgcataggtctcacaactcacgaacaaccttggtagagtctgagggatcggtacggagacgtctgtatctattccttaggggctacagagttaggaaaaatttcatctttattctttcctatcgtgcgaatttgttctgcaaatgctaattgaatttctactctgttcttccgcagatggcaagaacacgcgcttccacatctaatgatcagcagcccgaggaccccgtagcagctccagctaggggcaggggcagagggcgaggccgagctagaggccgtggtaggggcagagctcagccccgagcagcagcaccattggcggagcctcagattcatgctgaggaggttccagccccagctgatccagtgggcccaggtcaggtcccagaggagtttattgccaccccagttcttcaggacgcattagtccgattggttggattcatggagggtatttctagagcaggtttgctcccagcagcaccagccacatctcaggctggaggagggacttctactcctgctacacgtactccagatccattggttcctccagctccagcagttcagccaggaatggccgctcagccagctgcagcagttcagccaggtgtagcagttcatgctggagcaggtgcagttatgtctgcagatgctttatggagattggacaaattctccagattattcactctcacgttcagtggtactccttctgaggatgctcagaattatattatcagctgtcaggaggttcttgagactatgggtattctggagaccaatggggttgattttgctgcttatcgcctagccggatccgccaaggcttggtggagggatttctgttcatctaggccagcagggtcgccagcacttacctggacccagttctcggagttatttctgggaaagtttctcccagccactcagcgggaaactctccgcagtcagtttgagcgtctccatcagggtgatatgacagtcactcagtatgagactaggtttgtggagcttgctcgccatgccactgagatactcacctcagacagagaaagggtgaggagatttattaagggcttgaatcatccgattcgggtgcagatggccatgagtgccagtggtgggcttacttttcaggaggcagctgatggagctcgccgcattgagatggaccttcctcgtgggagaggtcaggggtcagataagaggtcccgtagttcaggcagattcagtggtacctcgtctggaggtagagattcttatggtagaggccatcctcctaggccttttcagtcagcccttcagacttcgcagggttctccaggcagcagtggttctcagtagtattattctgagcagcaattcttcagtgcactaccagctcccatcagtgcaccgccgcttcagagttatagtggaggatatccaggccgtcagggccagtattctcatcagcctaggatctgtcatggatgtggtgagccgggccacattgttaaattctgtccccatgctccaggtagatcacagcagcagggacctcgtcccatgattcaggcaccacctgtcccacagccaggcagaggcgggggtagaggacatagaggtggaggtcgaggtcacagaggtggagctcagacagatggaggtagaggtcagccagcagctgatggttctagagttaatgctcagggtggtggggcccagccccgattttatgcacttcagcccagaccagcggcagaggcctcagatgcagttattacaggtactattctggtttgtgacagagaggctttagtgttatttgaccctggctctacatattcgtacgtgtcttcttattttgcaccgtacctggttcagcctagtggtccattgagtatccccgtttatgtgtccacgccagtgggggatcctattatggttgatcgagttcatcgatcttgtgttgtggtaattgagggtcttgagacccgtgcggatttattaatcctagatatggtcgattttgatatcattttgggtatggattggctttttccatatcatgctatcttggattgtcatgccaagacagtcacctttgctctgccaaatttgcctcgtattgtatggcagggaattcctggccttatcagccgcaatgttatttcctatattaaggctcagcgtatggttgagaaagggtgtttggcttatctagcctatgttcgcgattccagcgccgaggttccttctgttgattcggtgcccgtggttcgcgagtttcctgaggtatttccttcagacttgccgggtatgccacccgacagggatattgatttttgtattgatttggctccgggcactcagcccatttctattcctccttatcgtatggccccgccggagttaaaagaattgaaagaacagttgcaggatttgcttgaaaagggtttcattagacccagtgtgtcaccttggggtgcgccggtattgtttgtgaaaaagaaagatggctcaatgcgaatgtgcattgattaccggcaattgaataaagttacagtcaagaacaagtatcctttgccgcggattgatgatttatttgaccaacttcagggtgccaaggtattttcaaaaatagatttgagatctggctaccatcagttgaagattagggcaacagatgttcctaagacagctttccgtactcggtacgggcattatgaatttctggtcatgtcttttgggttgacaaatgccccagcagctttcatggagttgatgaatcgggtattcagaccctatttagacttatttgtgattgtcttcattgatgatattttgatatactctcgcagccaggaggagcatgcacatcatctcagagtggctcttcagactctgaaggatagtcaattgtatgccaagttttcaaaatgtgaattttggctaagttcagttgcatttctgggtcatgttgtgacagtagaaggtattcaggttgatcccaggaagattgaggcagttaagaattggcctagaccagcatcagctacagagatccggagtttcttgggattagcaggttattatcggcgttttgtggaggggttttcatctattgcagccccgatgaccagattgacccagaagggtattcagttcgagtggtcagatgaatgtgaggcgagcttccagaagctcaaatcagccttgaccaccgcaccagtattaattttgcccacaggttcgggaccttatactgtttattgtgatgcttcccgtgttgggcttggtgcagtgttaatgcaggatggcaaggttattgcctatgcttcgaggcagctgaaagttcatgaaaagaactatccagttcatgacttggaattggcagcaattgttcacgcattgaagatttggaggcattatctatatggtgtagcatgtgagatattcactgatcacaagagccttcaatacttgtttaagcaaaaggagttgaatatgcgacagaggagatggttggaattgctgaaggattatgatatcaccattctatatcatccaggaaaggcaaatgtggtggccgatgccttgagcaggaagtcagtcagcatgggcagtcttgcttatattccggtcagtcagagaccgcttgctatggatgttcagacattagccaatcagttggtaaggttggatatttctgagcctagtcgagtgctagcttgcacggttgctcgctcttcattattggagcgtattcgcgacctgcagtttcatgatagtcatttatgtgtccttagagacacagtgcagcgaggaggtgccaagcaggtcaccttagatgctgatggagttttgagaatgcaagggcgaatttgtgtgccaaatgtagatgggcttcgagaattgattcttgaagaagctcacagttccagatattctattcatccaggcacagcaaagatgtatcaggatttgcgacaacattattggtggcgcaaaatgaaaagggatattgtggtgcatgtgtcgcggtgtttgaattatcagcaggttaaatatgaacatcagagaccgggtggtctatctcagagaattgaacttcctgaatggaagtgggagcaaatcaatatggatttcgttactggtcttccgttgactcggaagaagtttgattcagtttgggtcattgtggataggctgaccaagtcagcgcactttgttcctgttgccactacttattcgtctgagagactagctgggatttatatcagtgagatcgttcgccttcatggggtgcctatatctattatttcggaccgtggtccgcagttcacttcgcatttctggaaggcattccagaaagagttaggcactcaggttcgtttgagtacagcatttcatccccagacggatggtcaggccgagaggactattcagatattggaggatatgctccgagcctgtgttattgattttggaggctcgtgggattcattcctgcctttagcagagtttgcttataataatagctatcaatcgagcattcagatggctccttatgaagccttgtatggcagacgatgtcgttctccggttggatggtttgaaccgggagaggctcggttgttgggtacggatatggttcaggaggccttagataaggtcaagattattcaggataggcttcgtacagctcagtccaggcagaaaagttatgcagaccgcaaggttagagatttagccttcttggttggtgagcgtgtattgctccgtgtgtcgcctatgaaaggcgtgatgcgatttggtaagaagggcaagcttagccctagatttattggcccatttgagattctagagcgagtgggagaggtggcctataggcttgccttgccacctagtttatcagctgttcatccagttttccatgtatccatgcttcggaaatatcacggcgatccatcgcacgtgttagattacagcactgtccaattggacaagggtctgtcttatgaggaggaaccggtagctatattggaccggcaggttcgacagttgaggtcgaagagttttccttctgttcgtgttcagtggagaggtcagccccctgaggcatcgacctgggagtccgagtctgatatgcggagccgttatcctcatctatttcctgactcaggtacttatttcttttgttcgttcgaggacgaacgattgttttagaggtggagaatgtgacgacccaaagggtcatcatttgttttattagccatttcgagctttagaggccttgaaaacctccttataggttgcctcgatttgcgtgcgcagtccgggcgcgaagccggaaaatttatatgttgaaatacttgaattatgtgttcaaaatgatgaatttcaagtataatattgaaatagttgacttcggtcaacatttttggtaaacgggcctggacccgtgatttgaaaatttctgtagaaccgtcatgaaatttgggactcgtgcatatgttcggaattgaattccgaggtcccaagcccaagatatgggaatttttgtaaaactagcttttgaaattttcttaagtaattgaaaatgattaattgatggttgaatgtcgtatcgggctcgtattttggttccgacgcccggtacaggtcatatatggcgtttaagcgctacctgtgaaatttggttgaattcggacgtcgtttgacgtgtttcggactaaaagaggctaatttgaaagtttgaagttaaagtttggaatttaaggattttgagggtcgattctatgtttttgatgttattttagcgatttgatcgcacgagcaagttcgtaggatgattttgagtcaatgtgcatatttggtttggagccccgagggctcgagtgagtttcggataggtgtcggagggtgtttggccttatgaaatgcagcagaattgctgctgctgtcaggcactggtttccttctatgcgatcgcataggccttgctgcgatcgcatagagtaaaaatgataggctcagaattccttctatgcgatcgcgtaggctagatgcgatcgcatagtgtaaacgttgaggcccagttattccttctatgcgatcgcataggtgtgttgcgatcgcatagagtaaagtccaagggcccagaaatccttctatgcgatcgcattactcctccgcgatcgcatagagtaaatcccatggtgccagaaatccttctatgcgatcgcattactccttcgcgatcgcatagagtaaatgttgagtccccaggatttcttctatgcgatcgcattgctcttacgcgatcgcatagagcaaatatcagcccctctaattttcttctatgcgatcgcatcaaggccctgcgatcgcatagagcaatttttctgcccagcgatttaagtcacaaaacagaacagaaacgggattttcatcccatttcacaactctctcatcttcaacagctcccataggcgattcttggtcatttcttcatcaaagttcttgggtaagtgttctttaactcgttttcttcatttcccttcttcataaatcaaaatcttaggcctaaattcatggaaatgagtagaaaattagaaaaatccttatagttagggttttcaaataaattgcgatctagacctcgttttggggtcgaatatgagaacaaattgtatatttgtactcgtggatgaatgggttgtcggaaattggttcgaacctcgagttttggccacgtgggcccggggtcgtttttcactattcatggcagaatagtatgaattgtatttttggcaatttggaatattttgttgagtagatattgatgatattaaatcaattatgtatagatataattgatttggaggcgaattctaaaggaaagggcgtagcttaaggattgagattgccgtattcgcacgaggtaagtgtttgatctatcctagcttgagggaataggagttgagtctatttgctaattgctatgtgtggagtccgacgtatgggcatggtgacaagtatccatatgttgggggtctagcatgaccgtgggtcattaattttgattatttgatattgatatgatttttccacacttaatttgttaaattattaataatgtgataagtgtgagaaggaaattataaatgttaaatttcctagagcattagctcgaatcatgacttgataatttgagtaggaaatgaataaaaggtatcttgaaatgatatccttcactctttattatttaattctatgaaagaattaaattgtgggattgtaatcccttattggaatcttatgcacttgttgcatttgttatttatacggataatgtttgggctgaatgccacgtttgggccatgggccgacttgatatgtccttaaaggactgaggtgagcgaactagtatgatatgctcactatactttcattatgcattatttgcattcatatggatcgggctacacgtaccgtagcaatggaataatatattcctaaggatcgggctgcacgtaccgtagcaatgaatattgatatattcatgaggatcgggctacacggaccgtagcaatgaattaatatattcatgaggatcgggctgcacgtaccgtagcaatgaaatgaaatgaaatgaaatgaaatattatatgaaataaccggagggtcgggttgcacgccgcaacagagtatgaaccaagtattgaaatggtgtatgtaaagttgttcagcgatatttctgtacctgttgagttgtacagtttcatttccctaataaatgattatttatttaaagtgatgctagttcagagcatgtctttctccttcccaaataattattactgttatctgctatcttgttgcatatatatatattgaactgtacaggtttatgtgagtgtctggtcctagccttgtcacttacttcgccgggataggccgggcacttaccagcacatggggtcggttgtgctgatactacactctgtgctcttttgcacagatacaggctttgatcagcagcagtagcagtagtacgggcttgcattttggatatttggagatactgtgatgacccaaagggtcatcatttgttttattagccatttcgagctttagaggccttgaaaacctccttataggttgcctcgatttgcgtgcgcagtccgggcgcgaagccggaaaatttatatgttgaaatacttgaattatgtgttcaaaatgatgaatttcaagtataatattgatatagttgacttcggtcaacatttttggtaaacgggctcggacccgtgatttgaaaatttctgtagaaccgtcatgaaatttgggactcgtgcatatttccggaatcgaattccgaggtcccaagcccaagatatgggaatttttgtaaaactagcttttgaaattttcttaagtatttgaaaatgattaattgatggttgaatgtcgtatcgggctcgtattttggttccgacgcccggtacaggtcatatatggcgtttaagcgctacctgtgaaatttggttgaattcggacgtcgtttgacgtgtttcggactaaaagaggctaatttaaaagtttgaagttaaagtttggaatttaaggattttgagggtcgattctatgtttttgatgttattttagcgatttgatcgcacgagcaagttcgtaggatgattttgagtcaatgtgcatatttggtttggagccccgagggctcgggtgagtttcggataggtgtcggagggtgtttggccttatgaagtgcagcagatttgctgctgctgtcaggcactggtttccttctatgcgatcgcataggccttgctgcgatcgcatagagtaaaaatgataggctcagaattccttctatgcgatcgcataggctagatgcgatcgcatagtgtaaacgttgaggcccagaaattccttctatgcgaacgcatcttcactcctgcgatcgcactgttttatcccttcaactctatgcgatcgcatcactgttacgcgatcgcatagagcaaccagctgcccctctccatttcttctacgcgatcgcaatgagtatcgtgcgatcgcattgaccaaatagaccgtactctatgcgatcgcatcccaggccctgcgatcgcatagagcaatttttctgcccagtgatttaagtcacaaaacagaacagaaacgggattttcatcccatttcacaactctctcatcttcaacagctcccataggcgattcttggtcatttcttcatcaaagttcttgggtaagtgttctttaactcgttttcttcatttcccttcttcataaatcaaaatcttaggcctaaattcatggaaatgagtagaaaattagagaaatccttatagttagggttttcgaataaattgcgatctagacctcgttttggggtcgaatgtgagagtaaattgtatatttgtactcgtggatgaatgggttgtcggaaattggttcgaacctcgagttttggccacgtgggcccggggtcgtttttcactattcatggcagaatagtatgaattgtatttttggcaatttggaatattttgttgagtagatattgatgatattaaatcaattatgtatagatataattgatttggaggcgaattctaaaggaaagggcatagcttaaggattgagattgccgtattcgcacgaggtaagtgtttgatctatcctagcttgagggaataggagttgagtctatttgctaattgctatgtgtggagtccgacgtatgggcatggtgacaagtatccatatgttgggggtctagcatgaccgtgagtcattattcttgattatttcatattgacacgattttccacacttaattgttaaattattaataatgtgataagtgtgagaatgaaattataaatgttaaatttcctagagccttagctcgaatcatgacttgataatttgagtaagaaatgaataaaaggtatcttgaaatgatatccttcactctttattatttaattctatgaaagaattaaattgtgggattgtaatcccttattggaatcttatgcacttgttgcatttgttatttatacggataatgtttgggctgaatgccatgtttgggccatgggccgacttgatatgtccttaaaggactgaggtgagcgaactagtatgatatgctcactatactttcattatgcattatttgcattcatatggatcgggctacacgtaccgtagcaatggaataatatattcctaaggatcgggctgcacgtaccgtagcaatgaatattgatatattcataaggatcgggctacacggaccgtagcaatgaattaatatattcatgaggatcgggctgcacgtaccgtagcaatgaaatgaaattcaatgaaatattatatgaaataaccggagggtcgggttgcacgccgcaacagagtatgaaccaagtattgaaatggtgtatgtaaagttgttcaggaatatttctgtgcctgttgagttgtacagtttcacttccctaataaatgtttatttatttaaagtgatgctagttcagagcatgtcttcctccttcgcaaataattattacggttatcttctattttgttgcatatatatatcttgaactgtacaggtttatgtgagtgtctggtcctagccttgtcacttacttcgccgggataggccgggcacttaccagcacatggggtcggttttgctgatactacactctgtgctcttttgcacagatacaggctttgatcagcagcagcagcagtagcagtagtacgggcttgcattttggatatttggagataccgaggtagtcttgcagacgtccgcaggacccggtgttttcccctattttatttcagtatgttatctcatgtgttcgagataaacagtattatacttctttcagaccattatgtgtattattcttagaagttcgtgagtattgtgacaccagtttctgggtagtatttcatgttgggatttaagtatcgcagtttgttaaagtcctccgctaatttattcactgttattttctttaattattattaattgttttaaaatcagcattactaaaaatggttaattggtagagttgacttgcctagatcctactagtaggcgccatcatgacctccgatggtgggaaattcgggtcgtgacaagttggtatcagagcaactaggttgcataggtttcactactcacgaacaaccttggtagagtctgagggatcgttacggagacgtctgtatctattccttaggggctacgaagttaagaaaatttcgtctttattctttcctatcgtgcgaatttgttctgcaaatgctaattgaatttctactctgttcttccgcagatggcaagaacacgcgcttccgcatctaatgatcagcagcccgaggaccccgtagtagctccagctaggggcaggggcagagggcgaggccgagctagaggccgtggtaggggcagagctcagccccgagcagcagcaccattggcggagcctcagattcatgctgaggaggttccagccccagctgatccagtgggcccaggtcaggtcccagaggggtttattgccaccccagttcttcaggacgcattagtccgattggttggattcatggagggtatttctagagcaggtttgctccctgcagcaccagccacatctcaggctggaggagggacttctactcctgctacacgtactccagatccattggttcctccagctccagtacttcagccaggaatggccgctcagccagctgcagcagttcagccaggtatagcagtacatgctggagcaggtgcagttatgtctgcagatgctttatggagattggataaattctccagattgttcactctcacgttcagtggtactccttctgaggatgctcagaattatattatcagctgtcgggaggttcttgagactatgggtattttggagaccaatggggtcgattttgccgcttatcgcctagccggatccgccaaagcttggtggagggatttctgttcatctaggccagcagggtcgccacctttgtcctggaaccagttttcagagttatttctgggaaagtttctcccagccactcagcgggaaactctccgcagtcagtttgagcgtctccatcagggtgatatgacagtcactcagtatgagactaggtttgtggagcttgctcgccatgccactgagatacttaccacagacagagaaagggtaaggagatttattaagggcttgaatcagccgattcgtgtgcagatggccatgagtgccagtggtgggcttacttttcaggaggcagcggacggtgctcgccgtattgagatggatcttcctcgtgggaaaggtcagagttcggataagaggtctcgtaattcaggcagatttagtggtacctcgtctggaggtaagggttattatggtagaggccatcctcctaggccttttcagtcagcccttcagacttctcagggtgcgtcgggcagtagtggttctcatcagtattatcctgagcagcagttcctcagtgcactaccagctcccatcagtgcaccgccacttcagagctttcagggcggtcatgcaggacagcagggtcagtatctgcattctcagttgccacattcagctgggtgttatgagtgtggggatcttaatcacttcaggagattttgcccgagattgagaggtgctcggtctcagcagcagggacctcgtcccatgattcaggcaccacctgtcccacagccaggcagaggcgggggtagaggacatagaggtggaggtcgaggtcacagaggtggagcacagacagatggaggtagaggtcagccagcagctgatcgttctagagataatgctcagggtggtggggctcagccccgattttatgcacttcagcccagaccagcggcagaggcctcagatgcagtcattacaggtactattctggtttgtgacagagaggctttagtgttatttgaccctggctctacatattcgtacgtgtcttcttattttgtaccgtacctggttcagcctagtggtccattgggtatccccgtttatgtgtccacgccagtgggggatcctattatggttgatcgagtttatcgatcttgtgttgtggtgattgagggtcttgagacccgtgcggatttattaatcctatatatggtcgatttcgatatcatattgggtatggactggctttctccatatcatgctatcttggattgtcatgccaagatagtcacttttgctctgccaaatttgcctcgtattgtatggcagggaattcctggccttatcagccgaaatgttatttcctatattaaggctcagcgcatgattgagaaaggatgtttggcttatctagcctatgttcgcgattccagcgccgaggtttcttctgttgattcggtgcccgtggttcgcgagtttcctgaggtattcccttcagacttgccgggtatgccacccgaaagggatattgatttttgtattgatttggctccgggcactcagcccatttctattcctccttatcgtatggccccgccggagctaaaggaattgaaagagcagttgcaggatttgcttgaaaagggttttattagacccagtgtttcaccttggggtgcgccggtattgtttgtgaaaaagaaagatggctcaatgcgaatgtgtattgattaccggcaattgaacaaagttacaatcaagaacaagtatccactgccgcggattgatgatttatttgaccaacttcagggtgccaaggtattttcaaacatagatttgagatctggctaccatcagttgaagattagggcaacagatgttcctaagacagctttccgtactcggtacgggcattatgaatttctggtcatgtcttttgggttgacaaatgccccagcagctttcatggagttgatgaatcgggtattcagaccctatttagacttatttgtgattgtcttcattgatgatattttaatatactctcgcagccaggaggagcatacgcatcatctcatagtggctcttcagactctgaagaatagtcaattgtatgccaagttttcaaaatgtgaattttggctaagtacagttgcatttctgggtcacgttgtgacagcagaaggtatccaggttgatcccaggaagattgaggcagttaagaactggcctagaccagcatcagctacagagatccggagtttcttgggattagcaggttattatcggcgttttgtggaggggttttcatctattgcagccccgatgaccaggttgacccagaagggtattcagttcaaatggtcagatgattgtgaggcgagctttcagaagctcaaatcagccttgaccaccgcaccagtattgattttgcccacaggttcgggaccttatactgtttattgtgatgcttcccgtgttgggcttggtgcagtgttaatgcaggatggcaaggttattgcctaagcttcgaggcagctgaaaattcatgaaaagaactatccagttcatgacttggagttggcagcaattgttcacgcattgaagatttggaggcattatctatatggtgtggcatgtgaaatattcactgatcacaagagccttcagtacttgtttaagcagaaagagttgaatatgcggcagaggagatggttggaattgctgaaagattatgatatcaccattctatatcatccaggaaaggcaaatgtagtggccgatgccttgagcaggaagtcagccagtatgggcagtcttgcttatatcccggtcagtcagaggccgcttgctatggatgttcaggccttagccaatcagttggtaaggttggatatttctgagcctagtcgagtgctagcttgcacggttgctcgctcttcattattggagcgtattcgcgacctgcagtttcatgatagtcatttatgtgtccttagagacacagtgcagcgaggaggtgccaagcaggtcaccttagatgctgatggagttttgagaatgcaagggcgaatttgtgtgccaaatgtagatgggcttcgagaattgattcttgaagaagctcacagttccagatattctattcatccaggcacagcaaagatgtatcaggatttgcgacaacattattggtggcgcaaaatgaaaagggatattgtggcgcatgtgtcgcggtgtttgaattgtcagcaggttaaatatgaacatcagagaccgggtggtctatctcagagaattgaacttcctgaatggaagtgggagcaaatcaatatggatttcgttactggtcttccgttgactcggaagaagtttgattcagtttgggtcattgtggataggctgaccaagtcaacgcactttgttcctgttgccactacttattcgtctgagagactagctgggatttatatcaatgagatcgttcgtcttcatggggtgcctatatctattatttcggaccgaggtccgcaattcacttcgcatttctggaaggcattccagaaagagttaggcacccaggttcgtttgagtacagcatttcatccccagacggatggtcaggccgagaggactattcagatattggaggatatgctctgagcctgtgttattgattttggaggctcgtgggattcattcctgcctttagccgagtttgcgtataataatagctatcagtcgagcattcagatggctccttatgaagctttatatggcagacggtgtagatctccgattggatggtttgagccgggagaggctcgattattgggtacagatatggttcaggaggccttagataaggtcaagattattcaggataggcttcgtacagctcagtccaggcagaaaagttatgcagaccgcaaggttagagatttagccttcatggttggtgagcgtgtattgctccgtgtgtcgcctatgaaaggcgtgatgcgatttggtaagaagggcaagcttagccctagatttattggcccatttgagattctagagcgagtaggagaggtggcctataggcttgccttgccacctagtttatcagctgttcatccagttttccatgtgtccatgcttcggaaatatcacggcgacccatcgcacgtgttagattacagcactgtccaattggacaagggcctatcttatgaggaggaaccggtagctatattagaccggcagattcgacagttgaggtcgaagagttttccttctgttcgtgttcagtggagaggtcagcctcctgaggcatcgacctgggagtccgagtctgatatgcggagccgttatcctcatctatttcctgactcaggtacttctttcttttgttcgttcgaggacgaacggttgttttagaggtggagaatgtgatgacccaaagggtcatcatttgttttattagccatttcgagctttagaggccttgaaaacctccttataggttgcctcgatttgcgtgcacagtccgggtgcgaagccggaaaatttatatgttgaaatacttgaattatgtgtttaaaatgatgaatttcaagtataatattgatatagttgacttcggtcaacatttttggtaaacgggctcggacccgtgatttgaaaatttctgtagaaccgtcatgaaatttgggactcgtgcatatgtccggaatcgaattccgaggtcccaagcccaagatatgggaatttttgtaaaactagcttttgaaattttcttaagtatttgaaaatgattaattgatggttgaatgtcgtatcgggctcgtattttggttccgacgcccggtacaggtcatatatggcgtttaagcgctacctgtgaaatttggttgaattcggacgtcgtttgacgtgtttcggactaaaagaggctaatttgaaagtttgaagttaaagtttggaatttaaggattttgagggtcgattccatgtttttgatgttatattagcgatttgatcgcacgagcaagtttgtaggatgtttttgagttagtgtacatatttggtttggagccccgagggctcgggagtgtttttggaggtggttcgggttgtttttggacttggaaaactggcagattttctgcaatttttgcacaggctttttactctacgcgatcgcggcctcattcatgcgatcgcactgtgcagcccttcctactctacgcgatcgcatcatattgcacgcgatcgcaattcgttggcgagtcattccacgcgatcgcatcccgtcttacgcgatcgcgtaagccaaacggaccgcccagtgatttttcctctacgcgatcgcagagatccacacgcgatcgcgtagcttccagcgtttcttcaacgcgatcgcagccctattcatgcgatcgcgtaggtcaaatttccgcccagtgatttaagttccaaaacagaacagaaacgggattattcatcccatttctcaacttcctctctttcaacattctctttgggcgattttggagcaactcttcatcaaacttcttgggtaagtgttctttaactcgttttcttcatttcctttcttcataaatcaaaatcttaggccaaaatccatggaaataagtagaaaattagagaaatccttatagttagggttttcgaataaattgcgatctagacctcgttttggggtcgaatatgagaacaaattgtatgtttgtactcgtggatgaatgggttgtcggaaattggttcgaacctcgagttttggccacgtgggcccggggtcgtttttcactattcatggcagaatagtatgaattgtatttttggcaatttggaatattttgttgagtagatattgatgatattaaatcaattatgtatagatataattgatttggaggcgaattctaaaggaaagagcatagcttaaggattgagattgccgtattcgcacgaggtaagtgtttgatctatcctagcttgagggaataggagttgagtctatttgctaattgctatgtgtggagtccgacgtatgggcatggtgacaagtatccatatgttgtgggtctagcatgaccgtgagtcattattcttgattatttgatattgatatgatttttccacacttaattgttaaattattaataatgtgataagtgtgagaaggaaattataaattgtaaatttcctagagcattggctcgaatgatgacttgataatttgagtaagaaatgaataaaaggtatcttgaaatgatatccttcactcttcattatttaattctatgaaagaattaaattgtgggattgtaatcccttattggaatcttatgcacttgttgcatttgttatttatacggataatgtttgggctgaatgccacgtttgggccatgggccgaattgatatgtccttaaaggactgaggtgagcgaactcgtatgatatgctcactatacattcattatgcattatttgcattcatatggatcgggctgcacgtaccgtagcaatgaatattgatatattcataaggatcgggctgcacgaaccgtagcaatgaatattgatatattcataaggatcgggctgcacggaccgtagcaatgaaataatatattcatgaggatcgggctgcacgtaccgtagcaatgaaatgaaatgatatattcatatgggtcgggctacatgtaccgtagcaatgaaatatttataaataatcggagggtcgggttgcacgccgcaacagagtatgaaccaagtattgaaatggtgtatgtaaagttgttcagtgatatttctgtacctgttaagttgtacagtttcacttccctaataaatgattatttatttaaagtgatgctagttcagagcatgttttcctccttcccaaataattattactgttatctgctattttgttgcacatatatatcttgaactgtacaggtttatgtgagtgtctggtcctagccttgtcacttacttcgccgggataggctgggcacttaccatcacatggggtcggttgtgctgatactacactctgtgctcttttgcacagatacaggtcttggacagcagcagcagcatcagtagtaactcaggcttgtcttttggatatctggagataccgaggtagtcttgcaggcgtccgcaggacccggtgttttcttctattttacttcagtctgttatctcatgtattcgagacaaacagtattatatttctttcagaccatgatgtgtattattcttagaagttcgtgagtattgtgacaccagttcttgggtagtattttatgttgggatttcagtaccgcatctagtaattttattaagtcttccgctaattttatttattccacagtatttatattatgattctgtatggtagtttgggtgattctctggcaggtataggcccaattacagaggagactctgtcgaaatttttctaaaataagtattattaaaatggaatataagtagagttggcttgcctagctcctactagtaggcgccatcatgacccccgatggtgggaaattcgggtcgtgacaagttggtatcagagcgactaggttgcataggtttcacaactcacgaacaaccttggtagagtctgagggatcggtacggagacgtctgtatctattccttaggggctacggagttaggaaaaatttcatctttattctttcctatcgtgcgaatttgttctgcaaatgctaattgaatttctactctgttcttccgcagatggcaagaacacgtgcttcctcatctaatgatcagcagcccgaggaccccgtagcagctccagctaggggcaggggcagaggtcgaggccgacctagaggccggggtaggggcagagctcagccccgagcagcagcaccattggcggagcctcagattcatgctgaggaggttccagccccagctgatccagtgggcccaggtcaggtcccagaggggtttattgccaccccagttcttcaggacgcattagtccgattggttggattcatggagggtatttctagagcaggtttgctcccagcagcaccagccacatctcaggctggaggagggacttctactcctgctacacgtactccagatccattggttcctccagctccagcacttcagccaggaatggccgctcagccagctgcagcagttcagcctggtatagcagttcatgctggagcaggtgcagttatgtctgcagatgctttatggagattggacaaattctccagattgttcactctcacgttcagtggtactccttctgaagatgctcagaattatattatcagctgtcaggaggttcttgagactatgggtattttggagaccaatggggttgattttgctgcttatcgcctagccggatccgccaaggcttggtggagggatttctgttcatctaggccagcagggtcgccagcacttacctggacccagttctcagagttatttctggggaagtttctcccagccactcagcgggaaactctccgcagtcagtttgagcgtctccatcagggtgatatgacagtcactcagtatgagactaggtttgtggagcttgctcgccatgccactgagatactcacctcagacagagaaagggtgaggagatttattaagggcttgaatcagccgattcgtgtgcagatggccatgagtgccagtggtgggcttacttttcaggaggcagctgatggagctcgccgcattgagatggaccttcctcgtgggagaggtcagggggcagataagaggtcccgtagttcaggcagattcagtggtacctcgtctggaggtagagattcttatggtagaggccatcctcctaggccttttcagtcagcccttcagacttcgcagggtgctccaggcagcagtggttctcagcagtattattctgagcagcaattcttcagtgcactaccagctcccatcagtgcaccgccgctttagagttatagtggaggatatccaggccgtcagggccagtattctcatcagcctaggatctgtcatggatgtggtgagccgggccacattgttaaattctgtccccatgctccaggtagatcacagcagcagggacctcgtcccatgattcaggcaccacctgtcccacagccaggcagaggcgggggtagaggacatagaggtggaggtcgaggtcacagaggtggagctcagacagatggaggtagaggtcagccagcagctgatggttctagagttaatgctcagggtggtggggcccagccccgattttatgcacttcagcccagaccagcggcagaggcctcagatgcagttattacaggtactattctggtttgtgacagagaggctttagtgttatttgaccctggctctacatattcgtacgtgtcttcttattttgcaccgtacctggttcagcctagtggtccattgagtatccccgtttatgtgtccacgccagtgggggatcctattatggttgatcgagttcatcgatcttgcgttgtgttaattgagggtcttgagacccgtgcggatttattaatcctagatatggtcgattttgatatcattttgggtatggattggctttctccatatcatgctatcttggattgtcatgccaagacagtcacctttgctctgccaaatttgcctcgtattgtatggcagggaattcctggccttatcagccgcaatgttatttcctatattaaggctcagcgtatgattgagaaaggatgtttggcttatctagcctatgttcgcgattccagcgccgaggttccttctgttgattcggtgcccgtggttcgcgagtttcctgaggtattcccttctgacttgccgggtatgccacccgacagggatattgatttttgtattgatttggctccgggcactcagcccatttctattcctccttatcgtatggccccgccggagttaaaagaattgaaagaacagttgcaggatttgcttgaaaagggtttcattagacccagtgtttcaccttggggtgcgccggtattatttgttaagaagaaagatggttctatgcgtatgtgcattgattaccggcaattgaataaagttacaatcaagaacaagtatccactgccgcggattgatgatttatttgaccaactccagggtgccaaggtattttcaaaaatagatttgagatctggctatcatcagttgaagattagggcagcagatattcctaagacagctttccgtactcggtacgggcattatgaatttctggtcatgtcttttgggttgacaaatgccccagcagctttcatggagttgatgaatcgggtattcagaccctatttagacttatttgtgattgtcttcattgatgatattttgatatactctcgcagccaggaggagcatgcacatcatctcagagtggctcttcagactctgaaggatagtcaattgtatgccaagttttcaaaatgtgaattttggctaagttcagttgcatttctgggtcatgttgtgacagcagaaggtattcaggttgatcccaggaagattgaggcagttaagaattggcctagaccagcatcagctacagagatccggagtttcttgggattagcaggttattatcggcgttttgtggaggggttttcatctattgcagccccgatgaccagattgacccagaagggtattcagttcgagtggtcagatgaatgtgaggcgagcttccagaagctcaaatcagccttgaccaccgcaccagtattaattttgtccacaggttcgggaccttatactgtttattgtgatgcttcccgtgttgggcttggtgcagtgttaatgcaggatggcaaggttattgcctatgcttcgagacagctgaaagttcatgaaaagaactatccagttcatgacttggaattggcagcaattgttcacgcattgaagatttggaggcattatctatatggtgtggcatgtgagatattcactgatcacaagagccttcaatacttgtttaagcaaaaggagttgaatatgcgacagaggagatggttggaattgctgaaggattatgatatcaccattctatatcatccaggaaaggcaaatgtggtggctgatgccttgagcaggaagtcagtcagcatgggcagtcttcttatattccggtcagtcagagaccgcttgctatggatgttcagacattagccaatcagttggtaaggttggatatttctgagcctagtcgagtgctagcttgcacggttgctcgctcttcattattggagcgtattcgcgacctgcagtttcatgatagtcatttatgtgtccttagagacacagtgcagcgaggaggtgccaagcaggtcaccttagatgctgatggagttttgagaatgcaagggcgaatttgtgtgccaaatgtagatgggcttcgagaattgattcttgaagaagctcacagttccagatattctattcatccaggcacagcaaagatgtatcaggatttgcggcaacattattggtggcgcaaaatgaaaagggatattgtggcgcatgtgtcgcggtgtttgaattgtcagcaggttaaatatgaacatcagagacctggtggtctatttcagagaattgaacttcctgaatggaagtgggaacgaatcaatatggatttcgttactggtcttccgttgactcggaagaagtttgattcagtttgggtcattgtggataggctgaccaagtcagcgcactatgttcctgttgccactacctattcgtctgagagactagctgggatttatatcaatgagatcgttcgtcttcatggggtgcctatatctattatttcggaccgaggtccgcaattcacttcgcatttctggaaggcattccagaaagagttaggcacccaggttcgtttgagtacagcatttcatccccagacggatggtcagtccgagaggactattcagatattagaggatatgctccgagcctgtgttattgattttggaggctcgtgggattcattcctgcctttagcagagtttgcgtataataatagctatcagtcgagcattcagatggctccttatgaagctttatatggcagatggtgtagatctccgattggatggtttgagccgggagaggctcgattattgggtacagatatggttcaggaggccttagataaggtcaagattattcaggataggcttcgtactgctcagtccaggcagaaaagtcatgcagaccgtaaggtcagagatttagctttcatggttggtgagcgtgtattgctccgtgtgtcgcctatgaaaggcgtgatgcgatttggtaagaagggcaagcttagccctaggtttattggcccatttgagattctagagcgagtgggagaggtggcctataggcttgccttgccacctagtttatcagctgttcatccagttttccatgtatccatgcttcggaaatatcacggcgatccatcgcacgtgttagattacagcactgtccaattggacaagggtctgtcttatgaggaggaaccggtagctatattagaccggcaggttcgacagttgaggtcgaagagttttccttctgttcgtgttcagtggagaggtcagcctcccgaggcatcgacctgggagtccgagtctgatatgcggagccgttatcctcatctatttcctgactcaggtacttctttcttttgttcgttcgaggacgaacggttattttagaggtggagaatgtgatgacccaaagggtcatcatttgttttattagccatttcgagctttagaggccttgaaaacctccttataggttgcctcgatttgcgtgcacagtccgggcgcgaagccggaaaatttatatgttgaaatacttgaattatgtgtttaaaatgatgaatttcaagcataatattgatatagttgacttcggtcaacatttttggtaaacgggcccggacccgtgatttgaaaatttttgtagaaccgtcatgaaatttgggactcgtgcatatgtccggaatcgaattccgaggtcccaagcccaagatatgggaatttttgtaaaactagcttttgaaattttcttaagtatttgaaaatgattaattgatgattgaatgtcgtatcgggctcgtattttggttccgacgcccggtacaggtcatatatggcgtttaagcgctacctgtgaaatttggttgaattcggacgtcgtttgacgtgtttcggactaaaagaggctaatttgaaagtttgaagttgaagtttggaatttatggattttgagggtcgattctatgtttttgatgttattttagcgatttgatcgcacgagcaagttcgtaggatgattttgagtcaatgtgcatatttggtttggagccccgagggctcgggagtatttttggaggtggttcgggttgtttttggacttagaaatctggtgttttgctgtctgctgttgcccagttattccttctatgcgatcacataggtgtgttgcgatcgcatagagtaaagtccaagggcccagaaatccttctatgcgatcgcattactcctccgcgatcgcatagagtaaatcccatggtgccagaaatccttctatgcgatcgcattactcctccgcgatcgcatagagtaaatcccatggtgccagaaatccttctatgcgatcgcattactcctccgcgatcgcatagagtaaatgttgagtccccaggatttcttctatgcgatcgcattgctcctacgcgatcgcatagagcaaatttcagcccctctaattttcttctatgcgatcgcatcaaggccctgcgatcgcatagagcaatttttctgcccagcgatttaagtcacaaaacagaacagaaacgggattttcatcccatttcacaaatctctcatcttcaacagctcccataggcgattcttggtcatttcttcatcaaagttcttgggtaagtgttctttaactcgttttcttcatttcccttcttcataaatcaaaatcttaggcctaaattcatggaaatgagtagaaaattagagaaatccttatagttagggctttcgaataaattgcgatctagacctcgttttggggtcgaatatgagaacaaattgtatatttgtactcgtggatgaatgagttgtcggaaattggttcgaacctcgagttttggccacgtgggcccggggtcgtttttcactattcatggcagaatagtatgaattgtatttttggcaatttggaatattttgttgagtagatattgatgatattaaatcaattatgtatagatataattgatttggaggcgaattctaaaggaaagggcatagcttaaggattgagattgccgtattcgcacgaggtaagtgtttgatctatcctagcttgagggaataggagttgcgtctatttgctatgtgtagagtccgacgtatgggcatggtgacgagtatccatatgttgggggtcttgcatgaccgtgagtctctattatgcttatttgatatcgatgcaacttttccacattttaattgttgatttattcataatgtggatttcgtgaaagatgaattgaaatgatgattgttatggagcgttggctcaattgatgaaattggaaattcattaaaagtgaatagaaatgaaaaaggggatttttatgttgccttggtggaacagttatggtattctccttatggagatattttatgctatttgcattattgttttccttcgccctgaattactttgaatatttaattggcgaggaagagtgattaaagcacgaaggatgatgccgtgccttgttataaatgattatgcacgaaggataatgccgtgccttattataatttattatgcacgaaggataatgccgtgctttgatatgagagtgtgggaggaaaagcacgaaggttgttgccgtgtatttcatatgcttgtattggtgaggacgagagtaaaagcacgaaggttgatgccgtgcagatattgatttacttgtcctctttactattattctcccatttttatgtttatatcctgtcattatatattgttgttatcccagagcatgattccctttccggatattaaatgctatttttctgtgaattgtggtatatatttatgaactgtacaggtttatgtgagtgtctggtcctagccttgtcacttacttcgccgggataggccgggcacttaccagcacatggggtcggttgtgctgatactacactctgtgctcttttgcacagatacaggttttggacagcagcaacagcagcagcagtagtagttcaggcttgtcttttggatatctggagataccgaggtagtcttgcaggcgtccgcaggacccggtgttttcttctgttttacttcagtctgttatctcatgtattcgagacaaacagtattatatttctttcagaccatgatgtgtattattcttagaagttcgtgagtattgtgacaccagtcttgggtagtagtttatattgagatttcagtaccgcgtccagtagttttattaagtcttccgctacttttatttataccttgttattcgtattattattattctgtataggagtttgggtgttctctgacaggtggtgttaggcccaattacagaggagactctgtcgaaatttttataaaataaatgttgttaattggattataagtagagttggcttgcctagctcctactagtaggcgccatcatgaccccgatggtgggaaatttcgggtcgtgacaagttggtatcagagcgactaggttgcataggtctcacaactcacgaacaaccttggtagagtctgagggatcggtacggagacgtctgtatctattccttagaggctacggagttaggaaaatttcatctttattctttcctatcgtgcgaattgttctgcaaatgctaattgaatttctactctattcttccgcagatggcaagaacacgcgcttccacatctaatgatcagcagcccgaggaccccgtagcagctccagctaggggcaggggcagagggcgaggccgagctagaggccgtggtaggggcagagctcagccccgagcagcagcaccattggcggagcctcagattcatgctgaggaggttccagccccagctgatccagtgggcccaggtcaggtcccagaggggtttattgccaccccagttcttcaggacgcattagtccgattggttggattcatggagggtatttctagagcaggtttgctcccagcagcaccagccacatctcaggctggaggagggacttctactcctgctacacgtactccagatccattggttcctccagctccagtacttcagccaggaatggccgctcagccagctgcagcagttcagcctggtatagcagttcatgctggagcaggtgcagttatgtctgcagatgctttatggagattggacaaattctccagattgttcactctcacgttcagtggtactccttctgaggatgctcagaattatattatcagctgtcgagaagttcttgagactatgggtattttggagaccaatggggttgattttgctgcttatcgcctagccggatccgccaaggcttggtggagggatttctgttcatctaggccagcaggatcgccagcacttacctggacccagttctcggagttatttctgggaaagtttctcccagccactcagcgggaaactctccgcagtcagtttgagcgtctccatcagggtgatatgacagtcactcagtatgagactaggtttgtggagcttgctcgccatgccactgagatactcacctcagacagagagagggtgaggagatttattaagggcttgaatcagccgattcgtgtgcagatggccatgagtgccagtggtgggcttacctttcaggaggcagcggacggtgcccgccgtattgagatggatcttcctcgtgggaaaggtcagagttcggataagaggtctcgtaattcaggcagatttagtggtacctcgtctggaggtaagggttattatggtagaggccatcctcctaggccttttcagtcagcccttcaaacttctcagggtgcgtcgggcagtagtggttctcatcagtattatcctgagcagcagttcctcagtgcactaccagctcccatcattgcaccgccacttcagagctttcagggcggtcatgcaggacagcagggtcagtattcgcattctcagttgccacattcagctgggtgttatgagtgtggggatcttaatcacttcaggagattttgcccgagattgagaggtgctcggtctcagcagcagggacctcgtcccatgattcaggcaccacctgtcccacagccaggcagaggcgggggtagaggacatagaggtggaggtcgaggtcacagaggtggagcacagacagatggaggtagaggtcagccagcagctgatcgttctagagataatgctcagggtggtggggctcagccccgattttatgcacttcagcccagaccagcggcagaggcctcagatgcagtcattacaggtactattctggtttgtgacagagaggctttagtgttatttgaccctggctctacatattcgtatgtgtcttcttattttgcaccgtacctggttcagcctagtggtccattgggtatccccgtttatgtgtccacaccagtgggggatcctattatggttgatcgagttcatcgatcttgtgttgtggtaattgagggtcttgagacccgtgcggatttattaatcctagatatggtcgattttgatatcattttgggtatggattggctttctccatatcatgctatcttggattgtcatgccaagacagtcacttttgctctgccaaatttgcctcgtattgtatggcagggaattcctggccttatcagccgcaatgttatttcctatattaaggctcagcgtatggttgagaaagggtgtttggcttatctagcctatgttcgcgattccagcgccgaggttccttctgttgattcggtgctcgtggttcgcgagtttcctgaggtatttccttcagacttgccgggtatgccacccgacagggatattgatttttgtattgatttggctccgggcactcagcccatttctattcctccttatcgtatggccccgccggagttaaaagaattgaaagaacagttgcaggatttgcttgaaaagggttttattagacccagtgtttcaccttggggtgcgccggtattatttgttaagaagaaagatggttctatgcgtatgtgcattgattaccggcaattgaataaagtaacaatcaagaataagtatccactgccgcggattgatgatttatttgaccaacttcagggtgccaaggtattttcaaaaatagatttgagatctggctaccatcagttgaagattagggcagcagatgttcctaagacagctttccgtactcgatacgggcattatgaatttctggttatgtcttttgggttgacaaatgccccagcagctttcatggagttgatgaatcgggtattcagaccctatttagacttatttgtgattgtcttcattgatgatattttgatatactctcgcagccaggaggagcatgcacatcatctcagagttgctcttcagactctgaagaatagtcaattgtatgccaagttttctaaatgtgaattttggctaagtacagttgcatttctaggtcatgttgtgacagcagaaggtatccaggttgatcccaggaaaattgaggcagttaagaattggcctagaccagcatcagctacagagatccggagtttcttgggattagcaggttattatcggcgttttgtggaggggttttcatctattgcaaccccgatgaccaggttgacccagaagggtattcagtttgaatggtcagatgaatgtgaggcgagctttcagaagctcaaatcagccttgaccaccgcaccagtattgattttgcccacaggtacgggaccttatactgtttattgtgatgcttcccgtgttgggcttggtgcagtgttaatgcaggatggcaaggttattgcctatgcttcgaggcagctgaaaattcatgaaaagaactatccagttcatgacttggagttggcagcaattgttcatgcattgaagatttggaggcattatctatatggtgtggcatgtgagatattcactgatcacaagagccttcaatacttgtttaagcaaaaggagttgaatatgcgacagaggagatggttggaattgctgaaggattatgatatcaccattctatatcatccaggaaaggcaaatgtggtggccgatgccttgagcaggaagtcagtcagcatgggcagtcttgtttatattccggtcagtcagagaccgcttgctatggatgttcagacattagccaatcagttggtaaggttggatatttctgagcctagtcgagtgctagcttgcacggttgctcgctcttcattattggagcgtattcgcgacctgcagtttcatgatagtcatttatgtgtccttagagacacagtgcagcgaggaggtgccaagcaggtcaccttagatgctgatggagttttgagaatgcaagggcgaatttgtgtgccaaatgtagatgggcttcgagaattgattcttgaagaagctcacagttccagatattctattcatccaggcacagcaaagatgtatcaggatttgcggcaacattattggtggcgcaaaatgaaaagggatattgtggcgcatgtgtcgcggtgtttgaattgtcagcaggttaaatatgaacatcagagacctggtggtctatttcagagaattgaacttcctgaatggaagtgggagcgaatcaatatggatttcgttactggtcttccgttgactcggaagaagtttgattcagtatgggtcattgtggataggctgaccaagtcagcacactttattcctgttgccactacttattcgtctgagagactagctgggatttatatcagtgagatcgttcgccttcatggggtgcctatatctattatttcggaccgaggtccgcaattcacttcgcatttctggaaggcattccagaaagagttaggcacccaggttcgtttgagtacagcatttcatccccagacggatggtcagtccgagaggactattcagatattggaggatatgctctgagcctgtgttattgattttggaggctcgtgggattcattcctgcctttagcagagtttgcttataataacagctatcaatcgagcattcagatggctccttatgaagccttgtatggcagacgatgtcgttctccggttggatggtttgaaccgggagaggctcggttgttgggtacggatatggttcaggaggccttagataaggtcaagattattcaggataggcttcgtacagctcagtccaggcagaaaagttatgcagaccgcaaggttagagatttagccttcatggttggtgagcgtgtattgctccgtgtgtcgcctatgaaaggcgtgatgcgatttggtaagaagggcaagcttagccctagatttattggcccatttgagattctagagcgagtgggagaggtggcctataggcttgccttgccacctaatttgtcagctgtacatccagtatttcatgtatccatgcttcggaaatatcacggcgatccatcacacgtgctagattacagcactgtccaattggacaagggtctatcttatgaggaggaaccggtagctatattagaccggcagattcgacagttgaggtcgaagagttttccttctgttcgtgttcagtggagaggtcagcctcctgaggcatcgacctgggagtccgagtctgatatgcggagccgttatcctcatctgtttcctgactcaggtacttctttcttttgttcgttcgaggacgaacggttgttttagaggtggagaatgtgacgacccaaagggtcatcatttgttttcttagccatttcgagctttagaggccttgcaaacctccttataggttgcctcgatttgcgtgcacagtccgggcgcgaagccggaaaatttatatgttgaaatacttgaattatgtgtttaaaatgatgaatttcaagtataatattgatatagttgacttcggtcaacatttttggtaaacgggctcggacccgtgacttgaaaatttctgtagaaccgtcatgaaatttgggactcgtgcatatgtccggaatcgaattccgaggtcccaagcctaagatatgggaatttttgtaaaactagcttttgaaattttcttaaatatttgaaaataattaattgatggttgaatgtcgtatcgggctcgtattttggttccgacgcccggtacaggtcatatatggcgtttaagcgctacctgtgaaatttggttgaattcggacgtcgtttgacgtgtttcggactaaaagaggctaatttgaaagtttgaagttgaagtttggaatttatggattttgagggtcgattctatgtttttgatgttattttagcgatttgatcccacgagcaagttcgtaggataattttgagtcaatgtgcatatttggtttggagccccgagggctcgggagtatttttggaggtggttcgggttgtttttggacttagaaatctggtgttttgctgtctgctgctgcccagttattccttctatgcgatcgcataggtgtgttgcgatcgcatagagtaaagtccaagggcccagaaatccttctatgcgatcgcattactcctccgcgatcgcatagagtaaatcccatggtgccagaaatccttctatgcgatcgcattactcctccgcgatcgcatagagtaaatgttgagtccccaggatttcttctatgcgatcgcattgctcttacgcgatcgcatagagcaaatttcagcccctctaattttcttctatgcgatcgcatcaaggccctgcgatcgcatagagcaatttttctgcccagcgatttaagtcacaaaacagaatagaaacgggattttcatcccatttcacaactctctcatcttcaacagctcccataggcgattcttggtcatttcttcatcaaagttcttgggtaagtgttctttaactcgttttcttcatttcccttcttcataaatcaaaatcttaggcctaaattcatggaaatgagtagaaattagagaaatccttatagttagggttttcgaataaattgcaatctagacctcgttttggggtcgaatatgagaacaaattgtataattgtactcgtggatgaatgggttgtcggaaatcggttcgaacctcgagttttggccacgtgggcccggggtcgtttttcactattcatggcagaatagtatgaattgtatttttggcaatttggaatattttgttgagtagatattgatgatattaaatcaattatgtatagatataattgatttggaggcgaattctaaaggaaagggcatagcttaaggattgagattgccgtattcgcacgaggtaagtgtttgatctatcctagcttgagggaataggagttgcgtctatttgctatgtgtagagtccgacgtatgggcatggtgacgagtatccatatgttgggggtcttgcatgaccgtgagtctctattatgcttatttgatatcgatgcaacttttccacattttaattgttgatttattcataatgtggattccgtgaaagatgaattgaaatgatgattgttatggagcgttggctcaattgatgaaattggaaattcattaaaagtgaatagaaatgaaaaggggatttttatgttgccttggtggaacaattatggtattctccttatggagatattttatgctatttgcattattgttttccttcgccctgaattactttgaatatttaattggcgaggaagagtgattaaagcacgaaggatgatgccgtgccttgttataaatgattatgcacgaaggataatgccgtgccttattataatttattatgcacgaaggataatgtcgtgctttgatatgagagtgtgggaggaaaagcacgaaggttgttgccgtgtatttcatatgcttgtattggtgaggacgagagtaaaagcacgaaggttgatgccgtgcagatattgatttacttgtcctctttactattattctcccatttttatgtttatatcctgtcattatatattgttgttatcccagagcatgattcccttcccggatattaaatgctatttttctgtgaattgtggtatatatttatgaactgtacaggtttatgtgagtgtctggtcctagccttgtcacttacttcgccgggataggccgggcacttaccagcacatggggtcggttgtgctgatactacactctgtgctcttttgcacagatacaggttttggacagcagcaacagcaacagcagtagtagttcaggcttgtcttttggatatctggagataccgaggtagtcttgcaggcgtccgcaggacccggtgttttcttctgttttacttcagtctgttatctcatgtattcgagacaaacagtattatatttctttcagaccatgatgtgtattattcttagaagttcgtgagtattgtgacaccagtcttgggtagtagtttatgttgagatttcagtaccgcgtccagtagttttattaagtcttccgctacttttatttataccttgttattcgtattattattattctgtataggagtttgggtgttctctgacaggtggtgttaggcccaattacagaggagactctgtcgaaatttttataaaataaatgttgttaattggattataagtagagttggcttgcctagctcctactagtaggcgccatcatgaccccgatggtgggaaatttcgggtcgtgacaaaaggtgtataaaagtgtataatagtgtataagatgtgtttatacactcatatacactattatacaagattatacataattatacaaaaagctgatttcgtcttcttcattgcgttttttctgaaatttaactcaaatcttgctcaaatctactccaaatcacttcaaatttaaattttgaactcattttgatattttcaatcaattggaacaacacccaatccaaacaactaacaaacttaaaaaatcttatttttgaaagccaagctttgaatgaccttcaatggtggaatgttgaatcttcaattttcttacattgcaaccaggtgacacaggggagaagcagtaatggcggacgaccccttgaagcatatgtaaaagatgtgagaagaaaagagagtgaaagcaatgtttgtgagaacatagatttaactccataacttttagaagcaatagttgtaagaaaacatattttgaatttgctagtgctttcaaaatatgtacaatatgagttaggtcgggtaaaacttaaaaatatggaccatttttttgttatggtgtggagtcaagtgtattttcttgtaattctttcttaaataaaaactggacatatttacaatagagggggagttgaagctaatatctccatggaagtcatacacgatttttaccgggtacatgggaataaccaagtttactgcccagatctaccacacgtacccggcatcaaaattacaaaaaggctcctccctcaaaagatacgagggtttaattagtagttaggtttctctgcatcgaagcgatttttaggttgcgtaaacaagttagttcatctattttgtcactactagaaattcggcaaaaatcgaccaagaaaagccgaccaattttggcaaaatattttaatttttttttaagaaaccgaccaactttggtcggtttttgcaattaaaataaataaaaatttaaatttaaaaaatcgaccaactttggttggtaaattcggccggtcattttaaaaaccgaccaactttggtggtagaataaaaaataagacaatattaacataaaatgcaccaatagtttagtggtagaatagtatcccgccaaagtacacaccccgatttgattcccagatggtgaatcttttgattacataattaaaataccgaccaactttggtcgatttttttttgcgaccaaccttggtccttttacctttgcgaccaaccttggtcggtaattagcgaccaaccttggtcggtatactaaaacgaccaccaaaatagtgatcaagcgtgtttggacgcattttggtcggtaatttaccaaaaccgatcaatgttgatcggttattgtgatcgctaattaccggattagtagtgtgtgaggattcccaacgatcagtaatttaagacgtggttacttcagacgatttgctttcgcaagaagaaactcataaatatcctaactcatatttacagattaaatacttcagtatgaattgaagagtttttgtatattgagtgaaaactgatcaatatttacagattagaggagctcattagcctctcttatacatcttgtgtacaaagtgttactttaatttactacaaacatggggttcaaattcttatcacatatctctaaaagaatgttttttattttgtaacttgggtattaatgacaggtggttgggtggtgggtctaagaaaatttgttaagtcaactgataaatctctcccatacttttaattcgtcggccagcaacaatatgtacgtggcctttttgactttatccactttaagtctgattaatttaaattcgcgtcgtgtaatcttattttggaagtgtattggaggaaaacaaactcaccatttggacaaataacaagttgacaggtggcataggaatcgaagtagtaaagaagaatgaagatcagagaagatataagtaaacacccacggaatcgcctatgaggatgccgtgtctaatagctggaaaagaagaaataggtacggagtggatagttaaggatgctagaagccatggaagaggaaagatcattaaattaataatcacgaatatgaaaagaaatcaacacaatccgtgattatccgctagaagactttgttatcttaaccattacgaatcaccaatgtaacaggtaatcaatataataaatattagtaacagacaggaattaaatagggcaaaacaattacaaattgtactcttatatacatctccttatcatatcttgtatccccatcgagaaaatcacaaagtaacactatcaattgttaatattcttgctattatatgtccggttaggatatactttccctctaccacctaaatcaccaatataattaactaaataatgaaaactattatatcaagataataatacaccatactaaaaaggtttacattatatgttaattagacatgcagcgatggatctagagagtagagactactgtattgggtgaaaatttactatgaatggcattacacgtggcatgatacgtgtcatgaaaatagaagaaagaaagaagaaggaaaacagttacgggcatcaacaggaacggaagcaaaaggaagagaacagatacggggagagtaatgaaaagtccccgtacctaaatatcagaagaggagccgagaagtacgagatccaccaacaactatgggaaacgcatacgattccttgattaatatatcgagtaaacactaatacaatgctgtaaaccccctattggtccaggtaagtctattccttaaagaaatataaaaggaataggcttcaccctttatagactatatcagtaagtcaaggtagaagaaaacacgggttaatgtattaggtttcaattattaagcatagggacccactgtaaaaaggtcctcttagtggaatattaacggtaatattcaataattgagacaaggaggctccaaggcaatctatgattctataaataattgccttggtcccaagtatgagatatcgaataactgagaataacacttgatacatcacattcttgattcttgatttattgttctctttattcttattgaaagccattattattgtctcttgattatcagtaacccgataattattcattacattcaaagctttagtcaagatctattttttggttaaacagattggttccgttgccgggaagctgataatcttccttttttaatttttccaaaaatcatctcctaccactatgtcaaacaacgaaggtaacgttcttaacgaccaaatcaaccaagatgaaaggaatcaaccccttcagacacctcatgattcaccaagaggatctcacgaaatgagaactcccaatgatgaatctgaacgagtaggcgtggaggaggaagtcttaaacaaaatgatcgacgcaagagttgatagagttttagacgcaatattgagtcgtctacccaccacgtcaactcctaaagcacaagaggaccctcgttctgggttgattaactcaggggtcgctccaagtgaatctcatgaagatgagccaggtaattcttccatatctcactggcaaaatttagtactaaccttgcagcagcaactcaaggagcaaaacgaacgaatcgaacagatccctggagtgccacccgtaatcaagggggtagatatagacaaatattcccaacaaccttggaagtcatctgcagcacccttacctattcctaagaagttcagaatgccagatatcccaaaatatgacggcacaacagatccacgagaccatgtaacggcatacaccaccggtgtaaaaggcaacgatctgaccaaacaagaaatcggatctgtgctggtcaaaaaatttggagagactctcaccaaaggagcactaacctggtattctctcttacccgaagattctataaattcttttgctgagcttgcagactcttttataaaagcacactcgggagcacaaaaagtggaaaaaaggatggaagatatcttcaaaatcaaacaaggaaattccgagctgctgagagacttcgtagacagattccaacgggaacggatgaccctaccacacgtacctgacaactgggcagcaatagctttcgcaagcaacttgaacgacagaagctcggaagccacgagaaagctaaaggaaagccttcgtgaatttcccgctactacttggaacgacgtgtataacaggtacagtacgaagctcagaattgaggaggacatcgcaccccaacatagacgggaagaaagggacgggccccgacggtcagaagcagaaaaaaggtcaggtaagaataaatatgacccttgcattggacccgcaggtagggattcgagacctaagcagaaccaccacccgtacgagcaaaggtcaagaaacagggaaaccggctcttcatcaagattcaaaggaaatcgacacaaccaagagcaacggaatgatgataaaaccccatcaacacgagtcgccggatacaattttaatgtatcagatacggaactcgtagccattttaagaagtatgggagataaggtacggtggccaaaagaaatgcggtcgaatccaaatagacgaaatcctgatcaatggtgtgaattccacaacgatcacggacaccaaacttcagaatgcaggtttttgcaaagtgaggtagatcatttattaaaacaaggttatctcactgatttgtttagtgagaaagggaaacaggcttatatgaagaataggcaagagccaccaaaacaaccatcacccaaaagaaccgtgaatgtcatcagtggaggcgaagacgtttgtgggataacatatacagccacgacttcgaaaaagatgatgacccacgggaagcgggtacgacaacctgtggaagaagaaataaccttcgacgactcagatttagaaggaatcatcgttcctcacaacgatgccctggtaatatctttacttattcatgacactaaagtgaagcgagtcttggttgatccaggaagttctgcaaacatcatcctcttgagggtgttacaagaaatgcaaatagaggacaagatgatcccaaaagcccgcaccttaagtggattcgacaattcaaacgtgataaccaaaggtgagataactttaacaacatttgcagaaggaatagcgaaggaaaccaaatttcaggtagtagagatggagatggcatataacatgatcatggggagaccttggatccacgacatgaacgccgttccatcaactctacatcaagttatgaaattcccgtcaccatgggggatttgcaagatacatggagagcaacttgcggcaagaagcatttatgccgtaactaatgcaagcaacgaaggatagcaattacaggaattagctgagaataccctaacacgaacctcagctaatggagtacaggcagatctagatttagccatagccaaagaagtacgggcagatctagatttgaggcccgacatgatacaagagcttgaggaaaacgagcatatcaaaacaacgatagaggaactcgaagctgtcgtgttgtttgagcacttacctgaacgcaagatctacataggaaccaacctaagcccggaaatacgaggtatgataataaaatttttaagagatcacatagattgttttgcttggtcccacgctgacatgacaggcatatctccacacatgacgacacacaaactcaacgaggacccctccttcatcccgatcaagcaaaagaaaaggaaacaagggtctttcaaaaatcaaatcatccaagatgaaatccagaaattattgaaaaacgggtcaatacgggaggtaaagtatcgtaactggttagcaaacacggtggtcgtccctaagaaaactggtaagtggcgagtttgtgtggattacactgatttaaacaaagcctgcccaaaagactcttttccattaccacatatagatcaaatgattgatgcaactgctggtcatgaacttttgagtttcttagatgcatattcggggtacaatcaaattaagatgcaccccgatgacgaggagaaaacctctttcatcacagaacgagggacatattgttataaagtcatgccctttggtctgaaaaatgctggggcaacctatcaaaggttagtcacgaaaatgttccaagaacatttaggaaagacaatggaagtatatatagacgacatgctcgtcaaatctcagcattccaacaaccatatttctcatttaagtgcaacttttaaaattctgcaaaagtataatatgaaactcaatcctgagaaatgtgcttttggagtagcttccggaaaatttttgggttttcttgtatctaaccgtggcattgaagtaaacccttcccagatcaaagcaattgaagaaataccggacgtccttaacaacaaaaaggaggttcaaagactaacgggaaggatcgccgctttggggagatttatttcaaaatcctcagaaagatgcttcaaattcttctctgctcttaaaaaacaggaccgcttcgaatggaatgaagattgtcaacaagcactccggaacttgaaaagttacttatcaaaccctcctctgctaacaaaaccaaaggagggtgagaaactgcttatctacttggcaatctcggaagtagctgtaagtgcggtcttggtacgagaagagcaaggtaagcaatcacccatttactatgtaagtaaaactttattagacgctgaaacaagatatccacagttagaaaaactaacactagcactaatcatggcctctagaaagttgaggccttactttcaaagtcatcccatcgtagttgtcactaccttcccattgagaagtattttgcataaacatgaattatcaggtagactagccaaatgggcaatagaattaagtgaatttgacttaatctaccagcctagaaccgccataaaatcccaggtgttagccgatttcataactgattttagcccaggtatgcaattagaggcggaaaaagaaatgcagttgtttaacggcgggaacccgggaacttgggtgttattcactgatggttcctctaatgccaaaggggcgggattaggaattgtccttataccccccgttggagaaacaatcaggcaagctatcaaatgccctcccataactaataatgaagcagaatatgaagctgtgattgcaggtttagaattagctcaagaacttggaataacccagatcgcaatcaaaagtgattctcagcttgtcgtcaatcaaatgctggggacttatgctgctcgggaagcacgaatgcaaggataccttgacaaggtacgggaattggtaaaacaattccggtcgtggaaaataacacaaattcccagggaggaaaacacggaagccgatgctcttgctaatctcgcatcagcagcagatgtaaacaaagcagatacctccgtcgttcatttgtctcattccataatggaaccaagtcccattgaggtaaattttaataatttaacttgggattggagaaacgagatagttaactttttgcagcacgggatcgttcctgataacaaaacaaaggcttacgcacttcgcaaaaaggcagcccgttattgtttataccagggaaacctatatcgaaaaatgtttggaggacctttagcaaagtgtctcggaccttcacaaacggaatatgtaatgaaagaaatacatgagggacattgcggaaatcatgctggaggtaagtcactagtcaaaaccataatacgtgcagggtactattggcccaagatggaggaagaagcaaaaggattcgtatcaaaatgtgataagtgtcaaaggtacgggaataatatacatagcccagctgaacttctccatcctgtaatagttccatggcccttcatgaagtgggggatggacatcgtaggtccattgccccaagcaaaaggccaggtaaaattccttctcgtacttaccgattatttcactaaatgggtagaagctggagcattcaaacaggtacgggaaaaggaagttaaagattttatctggaggaacataatatgccgctatggtataccaaaggaaatcgtatgtgacaacggcccacaatttataggagcccagatcaccgaatttttccaaagctggcaaattaaaaggataacctcgacaccatatcatccagtaggaaatggacaagctgaatccacgaacaagaccattatcagtaatctgaaaaaaagattacaacaatcgaaggggaactggcctgaagtattaccagcggtattatgggcatatcgaacgacaacaaaactaagtacgggagaaactcctttttcaatggtttacggagttgaagccttaataccggtggaaataggcgaaccaagtatgaggtacgaacaaacaacggaaaaagcaaacaatgaagaattacgggtgaacctcgacttactggaggggaagagagaaatggctctagtaaggacggccgctcaaaaacaaataatcgagaggtactacaataaaaaggctcgaccaaggttcttcaaaattggggactttgtactcaaaaaagtcttccaatctacaaaagcggcaaattcaggcaaattaagcccaacatgggaaggaccttacaaaatcagtgaaatcacaggaaaaggagcctatgaacttgaaagcatggatggcaaaacattaccatcacattggaatgccgttcatctgaagaaatattatttctaaacaaaagtgcgagatcaggtatcatcatattaatattctttcttcaaatttaagatttcactaacgatttcagatgctaggctagaaccctaactcgtacaaaatgatgagtcataacctgcacggcaaaatgaaagaaatttaaaaatttctaagcccagggttacaataatctgaaacaagtacgagttgggaagtcttcatctttgatcaaacctcgagtcccgcacgttttcttgtatccaggaaaaaaaggacaagacatacaaatgcttggaatttcatacttcaaactccaaccacttgggggactagtatgagcttatacaaagaaacatctacgaacaagctgcaagctacgagctcatgtgtaaacaaagagtcacctacaaacaagctataaaacacgagcttcaaggaaagcagcgggctacgagatgtcaatctatatcatattaaaaaactgttacagaaaacagttacgggaaatacaagccacaagaatagctatgagctacgagccacaaggatagctacgggctacgaaatgttaattttatttttatacaaacaaaactgttatacaaaacagttacgggaaaagttatagatgtactccaaaaacatgtaacactcaaaaagcttatcaaaaaagtttttcatgctatacatgtacattcctatcttttccgccatattataacaccattatgaagaagagacgtcttcctcattcagtgtcgttttaaataaaagggccctcttttatgttctctcatattaacaaaattatgagaaaaatcttaaaagcatatttgaacaaaatatgctactataaagtcctaaagaaaataggcaaaaaacaaaaagacaaggaaaagaagtatcaaacaaacttccaaaaaaccttagtcaagatataaaaatatatgtctttacaaaatgccccattgcaaaaactgggaactttctcaaaaatatactaaggtgcaccacttgaaatggggggaggcacggatttgacttcagctgaaccggagataccaacatcaacgggagatgaggtagctacgggaacatcaacttctcccactgcctcaccctcgattgctcgagttttaactcctgaagcttcaacagtctcttcaatatgtgaagaatcctccacacccggagtttcgggtataacttgatctggagaaggagtagagacgggacaactcaatgcttcaaccacgtctgaaaccttcatcaactcagacttaaggtcgaaaccttcctttgaaacctccaataacgtgtcccgtcgggccttgaaataagctaactgaacctgggcattgaaatcatttgcaagagactcagaatctttatacagattatcatagtcatcttttaaaccaacaagctccacgttcaccgcttcatgttcagccagactagattccaaagtagctttaagcccagcaacctcgtctgaggaggccttcaagtctgaccgggcacgatccaaatccagtaccaaatcagctacccgtacctctttctcctgtacaagggcttcaaacctggcaatctctttggcagcctctgatgatgacttcattaaggcctccttctccctgaccaaggcctctttatcaacaatcaaggcctccttctcccttaccaaggcctccttatcagcaatcaaggcctccttctccttgacccaagcttccttttccttaatgagctggccagaatgttctttagcaacactaagctcaacagccaatgtcgctttctctctttctagcttgcccttatgggccctaaattcccccaaacttgattgggcattttcgaaacggctcttccagtctcgagccgcagcttgggccaccttaaccgccgtgtcgctatcacgcttctccctctccagagaagcaatccttgtcattaactccgtccccaaaagattggcctaacatgaaaggaagaagttataaaacatgggtataaaagtgtaaaaaagagtcgagtaaaaacagagtaataccttcagagtagaatgaacaatatcgttcaccaaagtcagattaccgtggttcctcattttatccctttcaacctctccaatgaggggaccaagccacacatcgttcccaccatcggcagtctttctcaaaagactataggtagcaggaacttccaaagtaaccgacctcattttcatgtccttcctactcttagtacccttcccggataaggttgaggaagaaccagagattacggaaggaggagtaacagaaatggaaggggcagccgtagctaaagaagtacgagcgggggcagacgagctaatcaagggaggaggaatagcatctgaagtaattgtaggaggaatagcatctgaagtagttgtaggaagaagggaaggaagcactacaacttcaggcgaagaaacatttactaccaagggaggaacaataggcacgggagtaatgagagcaagagaagatggggggacctcttgagaaagaggtccggaagattgcaaagcaaaaccccccgaacctgttattgccgtaggcaactgaatagaaacaggtacgggaacagaggtgtaaacttcagcctccaccgcgcgtctcctggtcctacgctcctctaaagtgctcgcctctcctttttctgtctccaatttcctttttaatctgatcaactccagctgtttattcgcccctatatcatcttcagctttagtacgaagggttcttgctacatcggaagacatccctctggcaatcaatcctgataaaaagaaggattgaagttagcaatcaaaaaaggattctttatccctcagcaaagggggggaatacataccatgggttttaaccttccatttgttcaaagaagagataaaattccaagacctttcatccttgggagcaaccttcaggattgtttccacccaaccacgaaagttggggataagcctcaattcgccaaaagtggctacacaggcaataaaaatcagatgcgggaaatgtgaataggtacgagtaaattggagaaaataaaaacttacgttcataattccattgttccggaaaaggaagattcgactcccccaacaaatgtgcggttttgacacccacataacgaacataccagccacgatcactgtcgtcgtcgggattcaccaaggctttcttactcctaggggctaaagaaaagaccccttgccgcagtaagcttggcctatataaatgcataaggtgtggaaaggtgaagtccacccccgccttagaagagaggtatctcaaacaagctacgaccctccacaccatagggccgacttgagcaagacagatactaaaaaatcgacaaaagtcgagaatagctgggtcgataggaggattgaaacctagagtaaaaggataggtataaacaaaagtataattgttcctaacggaagttattcgctgctctaaggtagggacagttaacataatacgttcaccccaattacaatccttcctaacatcaggaagaagaagagtggtgataagagaggggaaatcatcttccctcttaactttttcaaaaagtttctgtagagcttttttatcacctgaaaaagacaaatcctgaggcacgatttcctctacaagaggctcttgtaagtcgaattcatctttgttcttagaagaaggttttttaccacctaaagattttgcaggagaagaaagaggtttagaagaagaacctctacccctcgaaggctttgcagaagaagaaggaaccttcgaaccatctcgaactgaaccacgagaacttccaccactgccccgtcttgaaaaagtaattggagcgggcagatttggaaattgatcaacgattaaagtcttttttggctcagaatctgaagacgccattgttgaaaaattttggagaagaagatgaagagttgaaaaaggaatatctgataaacagatctgataagaatacgaagaagaaccgtcaaaaagaagaagacctatattaaaggtaaccgtcaaatcatgaagaaaggagacagacctagggagaaggaaaaccgtgttgcagaaccaatccgctatcaacacgtgtaagaagcattaaatggaaaggacgggataaatgtcagaaacattaaatggtgacaaaaattctcatcatttaagactccacttccccattattattatgatttaataaaagggaagtggggggactatctgtattgggtgaaaatttactatgaatggcattacacgtggcatgatacgtgtcatgaaaatagaagaaagaaagaagaaggaaaacagttacgggcatcaacaggaacggaagcaaaaggaagagaacagatacggggagagtaatgaaaagtccccgtacctaaatatcagaagaggagccgagaagtacgagatccaccaacaactatgggaaacgcatacgattccttggttaatatatcgagtaaacactaatacaatgctgtaaaccccctattggtccaggtaagtctattccttaaagaaatataaaaggaataggcttcaccctttatagactatatcaataagtcaaggtagaagaaaacacgggttaatgtattaggtttcaattattaagcatagggacccactgtaaaaaggtcctcttagtggaatattaacggtaatattcaataattgagacaaggaggctccaaggcaatctatgattctataaataattgccttggtcccaagtatgagatatggaataactgagaataacacttgagacattgcatccttgattcatgatctattgttctctttattcttattgaaagccattattatctattgtctcttgattatcagtaacccgataattattcattacattcaaagctttagtcaaaatctattttttggttaaacagattggttccgttaccgggaagctgataatcttcctttttaattcttccaaaaatcatcttttaccactatgtcaaacaacgaaggtaacgttcttaacgaccaaaccaatcaagatgaaaggaatcaaccccttcagacacctcatgattcaccaagaggttctcacgaaatgagaactcccaatgatgaatctgaacgagtaggcgtggaggaggaagtcttgaacaaaatgattgatgcacgagttgatagagttttagacgcaatactgagtcggctacctacaacatcaactcccaatcacaaaacacaagaggaccctcgttctgggttgattaactcaggagtcgctccaagtgaatctcatgaagatgagccaggtaattcttccatatctcattggcaaaatttagtactaaccttgcagcaacaactcaaggaacaaagcgagcgaatcgaacaaatccctggagtgccgcccataattaaaggggtagatatagacaaatattcccaacaaccttggaaatcatctgcagcacccctacctattcctaagaagtttagaatgcctgatatcccaaaatatgacggcacaacagatccacgagaccatgtgacggcatacaccaccggtgtaaagggcaacgatctgaccaaacaagaaatcggatctgtgctggtcaaaaaatttggggagactctcaccaaaggagcactaacctggtattctctcttacccgaaaattctgtaaattcttttgctgagcttgcagactcttttataaaagcacactcgggagcacaaaaagtggaaaaaaggatggaagatatcttcaaaatcaagcaaggagattccgagctgctgagagacttcgtagacagattccaacgggaacggatgaccctaccacacgtacctgacaactgggcagcaatagctttcgcaagtaacttgaacgacagaagctcggaagccacgagaaagctaaaggaaagccttcgtgaatttcccgctactacttggaatgacgtgtataacaggtacagtacgaagctcagaattgaggaggacatcgcaccccaacatagacgggaagaaagggacgggccccgaaggtcagaagcagaaaaaaggtcaggtaagaataaatatgacccttgcattggacccgcaggtagggattcgagacctaagcagaaccaccacccgtacgagcaaaggtcaagaaacagggaaaccggctcttcatcaagattcaaaggaaatcgacacaaccaagagcaacggaatgatgataaaaccccatcaacacgagtcgccggatataattttaatgtatcagatacggaactcgtagctattttaagaggtatgggagataaggtacggtggccaaaagaaatgcggtcaaatccaaatagacgaaatcctgatcaatggtgtgaattccacaacgatcacggacaccaaacttcagaatgcaggtttttgcaaagtgaggtagatcatttattaaaacaaggttatctcactgatttgtttagtgagaaagggaaacaggcttatatgaagaataggcaagagccaccaaaacaaccatcacccaaaagaaccgtgaatgtcatcagtggaggcgaagacgtttgtgggataacatatacagccacgacttcgaaaaagatgacaacccacgggaagcgggtacgacaacctgtggaagaagaaataaccttcgacgactcagatttagaaggaatcatcgttcctcacaacgatgccctggtaatatctttacttattcatgacactaaagtgaagcgagttttaattgatccaggaagttctgcaaacatcatcctcttgagggtgttacaagaaatgcaaatagaggacaagatgatcccaaaagcccgcaccttaagtggattcgacaattcaaacgtgataaccaaaggtgagataactttaacaacatttgcagaaggaatagcgaaggaaaccaaatttcaggtagtagagatggagatggcatgtaacatgatcatggggagaccttggatccacgacatgaacgccgttccatcaactctacatcaagttatgaaattcccgtcaccatgggggatttgcaagatacatggagaacaacttgcggcaagaagcatttatgccgtaactaatgcaagcaacgaagaatagcaattacaggaattagctgagaataccctaacacgaacctcagctaatgaagtacaggcagatctagatttagccatagctaaagaagtacgggcagatctagatttgaggcccgacatgatacaagagcttgaggaaaacgagcatatcaaaacaacgatagaggaactcgaagctgtcgtgttgtttgagcacttacctgaacgcaagatctacataggaaccaacctaagcccggaaatacgaggtatgataataaaatttttaagagatcacatagattgttttgcttggtcccacgctgacatgacaggcatatctccacacatgacgacacacaaactcaacgaggacccctccttcatcccgatcaagcaaaagaaaaggaaacaagggtctttcaaaaatcaaatcatccaagatgaaatccagaaattattgaagaacgggtcaatacgggaggtaaagtatcctaactggttagcaaacacggtggtcgtccctaagaaaactggtaagtggcgagtttgtgtggattacactgatttaaacaaggcttgcccaaaagactcttttccattaccacatatagatcaaatgattgatgcaactgctggtcatgaacttttgagtttcttagatgcatattcggggtacaatcaaattaagatgcaccccgatgacgaggagaaaacctctttcatcacagaccgagggacatattgttataaagttatgccctttggtctgaaaaatgctggggcaacctaccaaaggttagtcacgaaaatgttccaagaacatttaggaaagacaatggaagtatatatagacgacatgctcgtcaagtctcagcattccaacaaccatatttctcatttaagtgcaacttttaaaattctgcaaaagtataatatgaaactcaatcctgagaaatgtgcttttggagtagcttccggaaaatttttgggttttcttgtatctaaccgtggcattgaagtgaacccttcccaaatcaaagcaattgaagaaataccggacgtccttaacaacaaaaaggaggttcaaagactaacgggaaggatcgccgctttggggagatttatttcaaaatcctcagaaaggtgcttcaaattcttctctgctcttaaaaaacaggaccgcttcgaatggaatgaagattgtcaacaagcactccggaacttgaaaagttacttatcaaaccctcctctgctaacaaaaccaaaggagggtgagaaactgcttatctacttggcaatctcggaagtagctgtaagtgcggtcttggtacgagaagagcaaggtaagcaatcacccatttactatgtaagtaaaactttattagacactgaaacaagatatccacagttagaaaaactaacactagcactaatcatggcctctagaaagttgaggccttactttcaaagtcatcccatcgtagttgtcactaccttcccattgagaaatattttgcataaacatgaattgtcaggcagactagccaaatgggcaatagaattaagtgaatttgacttaatctaccaacctagaaccgctataaaatcccaggtgttaaccgatttcatagctgattttagcccaggtatgcaattagaggcggaaaaagaaatgcagttgtttaatggcgggaacccagggacttggatattattcactgatggttcatctaatgccaaaggggcgggattaggaattgtccttatgccccccgttggagaaacaatcaggcaagctatcaaatgccatcccataactaacaatgaagcagaatatgaagctgtgattgcaggtttagaattagctcaagaacttggaataactcagatcgcaatcaaaagtgattctcagcttgtcgtcaatcaaatgctggggacttattctgctcgagaagcacggatgcaaggataccttgacaaggtacgagaattggtaaaacaattccggtcatggaaaataacacaaattcccagggaggaaaacacagaggccgatgcccttgctaatctcgcatcagcagcagatgtaaacgaagcaaacacctccgtggttcatttatctcactccataatggaaccaaatcccattgaggtaagttttaataatttaacttgggattggagaaacgagatagttaactttttgcagcacgggatcgtccctgataacaaaacaaaggcttacgcacttcgcaaaaaggcagcccgatattgtttataccagggaaacctatatcgaaaaatgtttggaggacccttagcaaaatgtctcggaccttcacaaacggaatatgtaatgaaagaaatacatgagggacattgcggaaatcacgctggaggtaagtcactagtcaaaaccataatacgtgcagggtactattggcccaagatggaggaagaagcaaaaggattcgtatcaaaatgcgataagtgtcaaaggtacgggaataatatacatagcccagctgaacttctccatcctgtaatagttccatggcccttcatgaagtgggggatggacatcgtaggtccattgccccaagcaaaaggccaggtaaaattccttctcgtgcttaccgattatttcactaaatgggtagaagctggagcattcaaacaggtacgggaaaaggaagttaaagattttatctggaggaacataatatgccgctatggtataccaaaggaaatcgtatgtgacaacggcccacaatttataggagcccagatcaccgaatttttccaaagctggcaaattagaaggatgacctcgacaccatatcatccagtaggaaatggacaagctgaatccacgaacaagaccattatcagtaatctgaaaaaaagattacaacaatcgaaggggaactggcctgaagtattaccagcggtattatgggcatatcgaacgacaacaaaactaagtacgggagaaactcctttttcaatggtttacggagttgaagccttaataccggtggaaataggcgaaccaagtatgaggtacgaacaaacaacggaaaaagcaaacaatgaagaattacgggtgaacctcgacttactggaggggaagagagaaatggctctagtaaggatggccgctcaaaaacaaataatcgagaggtactacaataaaaaggctcgaccaaggttcttcaaaattggggactttgtactcaaaaaagtcttccaatctacaaaagcggcaaattcaggcaaattaagcccaacatgggaaggaccttacaaaatcagtgaaatcacaggaaaaggagcctatgaacttgaaagcatggatggcaaaacgttatcatcacattggaatgccgttcatctgaagaaatattatttctaaacaaaagtgcgagatcaggtatcatcatattaatattctttcttcaaatttaagatttcactaacgatttcagatgctaggctagaaccctaactcgtacaaaatgatgagtcataacctgcacggcaaaatgaaagaaatttaaaaatttctaagcccagggttacaataatctgaaacaagtacgagttgggaagtcttcatctttgatcaaacctcgagtcccgcacgttttcttgtatccaggaaaaaaggacaagacatacaagtgcttggaatttcatacttcaaactccaaacacttgggggactagtatgagcttatacaaagaaacatctacgaacaagctgcaagctacgagctcatgtgtaaacaaagagtcacctacaaacaagctataaaacacgagattcgtgaatagcagcgggcatacgaacttcaagggaagcagtgggctacgagatgtcaatctatatcatattaaaaaactgttacaaaaaacagttacgggaaatacaagccacaagaatagctatgagctacgagccacaaggatagctacgggctacgaaatgttaattttatttttatcatacaaacaaaactgttatacaaaacagttacgggaaaagttatagatgtactccaaaaacatgtaacactcaaaaagcttatcaaaaaagttttttcatgctatacatgtacattcctatcttttccgccatattataacaccattatgaagaagagacgtcttcctcattcagtgtcgttttaaataaaagggccctcttttatgttctctcatattaacaaaattatgagaaaaatcttaaaagcatatttgaacaaaatatgctactataaagtcctaaagaaaataggcaaaaacaaaaagacaaggaaaagaagtatcaaattaaacttccaaaaaaaaccttagtcaagatataaaaatatatgtctttacaaaaaaccccattataaaagctggggacttcttctaccaccaaaaatctaaaaaatactaaggggcatcctttgaaatgggaggaggcacggacatgacttcagctgaaccggaggtaccaacatcaacggaagatgaggcaactacgggaacatcaacttcccccactgcctcaccttcgattgcttgagtttcaacccctgaggcttcagcaatctcttcaacgctcgaaggatcctccattcccggagtttcaggtatggcttgatctggggaaggagtagaaacgggacaacttaatacctcaatcacatctgaaaccttcgtcaactcagatgcaaggtcaaaaccttccttggaaacttccactaaggtatcccgtcgggcattaaaataagccaactgaacctgggtattgaaatcatttgcgagaggctcagactccttaagcagattatcataatcatcttttaacccagcaagctccaccttcatcgcttcatattcagccaagttagattcaagagtagctttaagcccaacgacctcatctgaagagaccttcaaatctgaccgggcacgatccaaactcaatgtcagttcagtcgcccgtacctctttctcctgcacaagagcttcaagcttggcaatctctttggcagcctctgatgatgacttcattaaaacctccttctccctaaccaaggcccccttatcagcaatcaaggcctccttctccctaaccaaggcctccttctcagcaatcaaggcctccttctccttgacccaagcttccttttccttaatgagctggccagaatgttctttagcaacactaagctcagcagccaatgtcgctttctctctttctagcttgcccttatgggccctaaattcccccaaacttgattgggcactttcaaaacggcccttccagtctcgaaccgcagcttgggccaccttagccgccgtatcactgtcacgcttctccctctccagagaagcaatccttgtcattaactccgtccccaaaagattggcctaacacaagaaggaagaagtatgagacgggcttataaaaataaaggaaggaccagataaaattcgaaaataagagtaataccttcaaagaagaatgaacgatatcattcaacaaggtcaggttactatggttcctcattttgtccctttcagcatctccaataagaggaccaagccacacatcgttcccaccatcggcagtctttctcaaaagactatgggtagcaggaacttccaaagtaaccgacctcattttcatgtccttcctactcttagtacccttcccggataaggttgaggaagaaccagagattacggaaggaggagtaacagaaatggaaggggcagccgtagctaaagaagtacgagcgggggcagacgagctaatcaagggaggaggaatagcacctgaagtggttgtaggaagaagggaaggaagcactacaacttcaggcgaagaaacatttactaccaagggaggaataataggcacgggagtaatgagagcaagagaagatggggggacctcttgagaaagaggtccggaagattgcaaaacaaaaccccccgaacctgttattgccgtaggcaactgaatagaaacaggtacgggaacagaggtgtaaacttcagcctccaccgcgcgtctcctggtcctacgctcctctaaagtgctcgcctctcctttttctgtctccaatttcctttttaatctgatcaactccagctgtttattcgcccctatatcatcttcagctttagtacgaagggttcttgctacatcggaagacatccctctggcaatcaatcctgataaaaagaaggattgaagttagcaatcaaaaaaggattctttatccctcagcaaagggggggaatacataccatgggttttaaccttccatttgttcaaagaagagataaaattccaagacctttcatccttgggagcaaccttcaggattgtttccacccaaccacgaaagttggggataagcctcaattcgccaaaagtggctacacaggcaataaaaatcagatgcgggaaatgtgaataggtacgagtaaattggagaaaataaaaacttacgttcataattccattgttccggaaaaggaagattcgactcccccaacaaatgtgcggttttgacacccacataacgaacataccagccacgatcactgtcgtcgtcgggattcaccaaggctttcttactcctaggggctaaagaaaagaccccttgccgcagtaagcttggcctatataaatgcataaggtgtggaaaggtgaagtccacccccgccttagaagagaggtatctcaaacaagctacgaccctccacaccatagggccgacttgagcaagacagatactaaaaaatcgacaaaagtcgagaatagctgggtcgataggaggattgaaacctagagtaaaaggataggtataaacaaaagtataattgttcctaacggaagttattcgctgctctaaggtagggacagttaacataatacgttcaccccaattacaatccttcctaacatcaggaagaagaagagtggtgataagagaggggaaatcatcttccctcttaactttttcaaaaagtttctgtagagcttttttatcacctgaaaaagacaaatcctgaggcacgatttcctctacaagaggctcttgtaagtcagattcatctttgttcttagaagaagattttttaccacctaaagattttgcaggaaaagaaagaggtttagaagaagaacctctacccctcgaaggctttgcagaagaagaaggaaccttcgaaccatctcgaactgaaccacgagaacttccaccactgccccgtcttgaaaaagtaattggagcgggcagatttggaaattgatcaacgattaaagtcttttttggctcagaatctgaagacgccattgttgaaaatttttggagaagaagatgaagagttgaaaaaggaatatctgataaacatatctgataagaatacgaagaagaaccgtcaaaaagaagaagacctatattaaaggtaaccgtcaaatcatgaagaaaggagacagacctagggagaaggaaaaccgtgttgcagaaccaatccgctatcaacacgtgtaagaagcattaaatggaaaggacgggataaatgtcagaaacattaaatggtgacaaaaattctcatcatttaagactccacttccccattattattatgatttaataaaagggaagtggggggactatctgtattgggtgaaaatttactatgaatggcattacacgtggcatgatacgtgtcatgaaaatagaagaaagaaagaagaaggaaaacagttacgggcatcaacaggaacggaagcaaaaggaagagaacagatacggggagagtaatgaaaagtccccgtacctaaatatcagaagaggagccgagaagtacgagatccaccaacaactatgggaaacgcatacgattccttgattaatatatcgagtaaacactaatacaatgctgtaaaccccctattggtccaggtaagtctattccttaaagaaatataaaaggaataggcttcaccctttatagactatatcagtaagtcaaggtagaagaaaacacgggttaatgtattaggtttcaattattaagcatagggacccactgtaaaaaggtcctcttagtggaatattaacggtaatattcaataattgagacaaggaggctccaaggcaatctatgattctataaataattgccttggtcccaagtatgagatatcgaataactgagaataacacttgatacatcacattcttgattcttgatttattgttctctttattcttattgaaagccattattattgtctcttgattatcagtaacccgataattattcattacattcaaagctttagtcaagatctattttttggttaaacaactacgtcgctgcgtctaaatcagaccccatacaattcatagtctcatattatatttagggtatatccgatccacgtattgataattatctgatttgcaatttggcaggtggcaggccctaatagagacccaacgagtagttttttgaaattaaaaaatttcgagtagtttttttttaaatacaaaaatttattatattagtataggggaggaggaaataaatgctacgccactaacggagtttgaactttttatctcaattgtgaaaaaaaaaagtattcaccaagtaaagcagactatggcatttagggcttctgaatatctgattatacatgattaatttaagggagaaatttaaaaatagccagatttacaattggtcattcaaaaatagcccagttttaaaagtaatcgaaatttagctacttttaatgtaaagataaatttgagcgaaaacactattcaaactccggaaaatacgccctcatattatacgggagttccagcataagtatgcttgaactcccgcatattatacgggagttccaggataactatgctggaactcccatataatatgcgagagttcaagtataattatgctggaactcccgcataatatacgcgagttccagcaagtataaatgtccagtataatatactggagtttggagcaccggtgctccagtctcccgtatattatacaggaatcaacaaagtataccggtccagcataatatgctggagttcgtacacaaatgcaccaaactcccgtatattatacgggaccggtctctgttgcagcaaaatagtggctatttttcattgacttggtaaacgctggctatttttgattgaccagtgcaaaaactggctataccatgctattttgacttaatttaacttatatatactgtaaaaaaatatacaagagttgtttagtaggcatatactgaccagtgtattttagcccattgatctaatttatagacggccctctaaacttctcaaaattgcaagagttgtttagtaggcatatttactataaacttctcaaaattgcaagagttgtttagtaggcatatttactataaacttctggtgtttaataagttgaactcctagataacgtatccaactaaaaatttgacaacttttgggggtctccaatgtattctgcctaaattttatctaaacataatatatgttaatgcatttcactttaattttacaaaaattgaatgagtttaagctctatgcactaacgatataaggaatttttacattattaaatcatttataggtggtaagcaatattctataactgatatgttgggctaacacggtccaaaatactttcaacatagtgtaatattatccgctttaggctaaactcacacgatttttcctaaaaggactcatactattaagagatccctacaccttttatgtaggctccccaatgtgggactttgttcgcataccaaacaatctccccgtcgaactaagttccacatgaccaattactacaattcacgggtctccccctcggactaagtttcatgtggctcattaccacgatccatgagtcaatttcagagattcaatgtttttcacctacattgttagagtattatggcaatcaaagcccacaactagcttatttttgtgtgcccgtcgctccgcaccatcactctgtcatgtacatactcggagctctgttaccagttgttggtgctaacgtagtctaaagatactcttaatatggtgtgatattatctgctttggatcaaacccgtacgttttttttttcaaaaggtctcacaccattaagagatccttacaccttatgtgtaagttctcaatcttttctactatcaatattggactttattcgcacaccaacatcaaatcacactattacttacattgaaaagattagtgtatttaacttaaatccaaaagaaaacgagatatggggaaccaatgaagggtagtatcatactactaatattttttgccaactcaatagtgaattcaagactcttcattactctcttcacttgccaaccaaatactggtcaacatactccataaatgcaccctgtgcattgtcccctcacacctccaagtcatgtccttcccttgtatctgaaatgcattcaattcttactataaatagagaccaatgatgcatcagtttctccatccttttagtttcaaatatcataactaagcttggctacaaaagaaaaatgggttccaaggcatttttgtttcttggcctttgtttggctatttttgtaatgataagctctgaggttttagctagggagttggctgagacttccaccactgcaaaagaggactgtaagcatcttgccattattttctcatttaaattatttaatctttcaactagtagtaaagatattatttcctctgaagcaagtacttggggtataatattgaatatggtgtatcagtaatgctgggattagtaatactggaattagttatgctaggattatttcttgtcgattgtttggtttgatgaattaaaggttttgaaagagcaattttgtctttatacatacttatttacgtgttaaaaactatggtacatattgctaatgccataatttgatatatacataatattagtattgaatatgtataactaacacaagtattagttatacataggttgaaaaatacctccaaacaaggaactaataataccaaaggtaatacatgtgtattatttttcctaatacatcataccaaacgaccccttagatttacacgtatgtcattcctaaatgcaagtttataatatttcatttgacatgaacatagcaaatattatcattaatgtgcttgtatgacgaaaaagtatatataagtaaaggatttaacttatatatattgacagtgtaaaagaaaattatatgatctttgtattcgacctaatactacaaaaacttttcactatcgacatgtagaaattatacttgtaagattatggattacggcaaaattgtgttaatttctagtttagagttgaagcagaaccttggagcaacagtgaaattgtctccatttgacctataaattacaggtttgacccgtggaagcaaccgtgaatgcttgcattagggtagtttgtctacatcacatcccttggggtgtggcccttctccggaccttacatgaacgcggagtgtcttgtgcaccaggctaccctttgctagtttagagttagtacaagaataaaacagctaataggaataacatacctttttcacacaattgatgcagcaaagaaatctgataacaagaatgaagtgcatgaagatcaactaggcggcggataccccggtggcggctaccccggtggtggctaccctggcggtggatacccgggtggtggataccctggcggcggataccctggaggcggataccctggccgcggataccccggtggtggccgtggtggaggcggccgcggtggtggtggacgtggaggatactgccgctatggttgttgcggccgccgcaattactacggctgcagcaggtgttgctactacaaaggtgaggccatggataaagtgactgaagggaaacctcaacactgatcatcgtgtaatatttaaaacctttgtaatgggtaaagttgtaatagtaatgctctttttactttaaagcttgttgtgttatgtatgaataaaagacattatgtaatgatgtttgttacacaatggcgttataatatatctctttgatgttcttctcatttcctaaacaaactcctttccttccataaaatataaaatttgcagaagacatatatacaggactacaggagttaaatatacagataactaacgtattcaaagacttctaattagaggcggattcagaatttaaatatgatgaattatcttcagactttaggttttcattgcaccatattggcgtcaacaatctcaagatttctacatttggggctaacttgaagtctgttgaggcatctagacggaagactaaagactcgtgtattgggccacatgctaaagtatgtttatgtatggggccacatgctaaagagagtttatgtattgcaccacaaggtctgctggttcaacacagcccaacacataaacagaagaggacaagccatttagttcaaatacaaaatagctataatacagctttagattcctgaatatacctctaacggtatacagaaaattgtacatggtacattagtacatatagctgtatttttgtttatattagatagccaatacataggagacatgtataggtttaattttctgtccttatctattgaaaaattgtataaaaatccttgtacatattgaatagaatatattaaaggtgtcaaggggttgggatggtgggggtagaggaaaagggaatcggccggtttcggtagcgggacggttaccggttattttttactaggtttaccagttctgggcttctccggtgctaaattgaactggaatggttctgggcctaatgggccagttttatttaaattttttttgtattttatataacaatcgtaatttatattacaacaacaacaacaactacccagtgtagtcccacagagtgggatctagggaaggtaatacgtacgcaggccttacccctacccgaaatggcagagaggctatttccaatcgaccctcggctcaggaacaggaaaagaaaaaataaaaataaaaacaaaagagtattagtaactccagcataaatcacataaataattatgtaaacataaacaataaatgacatggcatgcaaaaagaaaagataaacaaaaacaaaaacaaaagggcattagtaactccagcagatatcacataaataattatgtaaccataaaccataaataaaatggcatgcaataacaacgaccagtaactaccataaggggcacaatacaatacacaaaccatctatggagagccccaccaaaccccgcccagagcctctatcctacaaccctgatactacacctccggactttcctatcaagggccatgttctcgaaaatccgcattctgtccatgtcctgcctaatcacctctccccaatacctctttggcctccctctgccacgactcgcgccaaccaccgtcagccgctcacaactcctcaccggggcatcggggcttctcctccgcacatgcccgaaccacccgagtctcacttcctgcagcttctcatctactggggccacccacaccttcttccgaataacttcattcttaatcttatctaacctggtgagcccgcacatccacctgagcattatagttcttcaccggccagcactctgccccatacaatatggcaggtctaaccacaactctataaaacttccccttgagtttctgtggcactttcttgttacacaagactcctgatgcaagcgtccatttcgaccaccctgcccctatacggtgagtgacatccccgtcaatctctccgtctccctgaatcaccgacccaagatatctgaaactgtccctcttggcgatgacctgggatccaagcttcacatccctacctccttcttcttcgctcgactcggcgctaaacttgtactccaggtattctatcttagacctgcttagtttgaaacccttagactcaagagtctgtctccagacctccaacctctcgttaacaccgacccttgtctcgtctatcaagactatgtcatcagcaaataacatacaccatgacacatccccttgaatatggtgtgttagagcatccatcaccaaagcaaataagagagggctaagcgcagatccttggtgaagccccataattacatggaaatgatctgagtcgctacccaccgtcctaaccctagtcttagctccatcgtacatgtccttgatcactcttatgtaggcttccggcatgctcttcgcctataggcacctccatagcacctcccttgggaccttatcgtacgccttctccaagtcgataaacaccatgtgcaggtccttcttcttatccctgaactgttccaccaatctcctaacaaggtggatagcttctgtagtggagcggccaggcatgaaatcgaactggttcacggatatagacgtcatctccctcaccctcgcctcaaccacccgctcccagactttcatggtgtggcttagtaatttgatacccctatagttgttacaacactggatatcccctttgttcttatacaagggcagcattgtactccacctccactcctccggcatcttcttagtcctgaagatcacattgaacaacctggacagccactccgctcctgtcctacccatgcatttctagaactccaccgggatctcatctggcccggacgctcgacccctactcatcctacgcaaagcccccacgacctcctccaccctgatgcgcctgtagtacccaagatctctatgacactctgaattccctaactcccctagctctatgtctcgatccccctcctagttaagcaggtctcgaaagtacgcctgccacctcttcttgacttgagactaccccatcagaactctaccatcctcgtccttgatgcacctaacttggtctagatcccgcgccttcctccccctcactttagccaacctgaataagttcttgtccccatctttctcccccaattcctcgtacatgcgaccaaacgccgcatttttagcttccgtgaccgccagcttcgcttccttcctcgccaccttgtagctctccctattcactctcctttcctcctcacttgtgctccttgccaacttagcaaacgccgccttcttcacctccacttttccttggactacatcgttccaccaccagtcaccttgatgtctgcctgaatagcccttggctatcccgagcacatctcgcgctgcctccctaaccaggttcctcgtccagaccttctacatgtataaaatgaatgtttgaataaatttcaaaagttttaaaagccttataattgaaaaattcattacgaatttaagataatacaatgaatatgaaaaaaatataacatatactataagtcatatattggagtgttgataacttgaatatgtaaggatcaaactttaaaggctttcatttcatattttcattgtataataatacttcaaattaacttgtttaacaaactaaattattaagcttaaatataagtctaataattttaaaataacacaaattatctcaaatcaacttaaatacaaatttctggaggatgctcaagacaactcttcatgtgcctccttaaacatcatgtgccctcccacttccgacgaacatttaagactcgatcatagttcttccactctaattttcaaacttcttcattttcttctatcacctcaaagtgttcccaaacatatgagcgcactcaagaagcacgggggcgtgatttaacttgaattgaaaatttggatttgagaattgagagataagtgaagaaatgaagaagggggaggggtctatttacaattttttaaagggctaaattaataaataataaaagttttatttttgaaaaaaaaacccaaaaaataactattcatgcaaattagcagttatgcaatggtcaaaatggcagctggtcgttgccaacaatcaacattacaaaaaaaattacttagccgttgaatcgatctgggccggtccggttcaccggttaaaaaatgacatgaccttatcgggtcgtaccggtccggttaaccgatatcaaaattttccccggtacaggctggtttccatcccaacccaaccgtgcccggttcggtctgggtatatccggaccagcgtggcccatttgacagatttagaatatatagaaaaattctcaagattttgtagctcactatttctgcacaccattacatttatgaaattattggtccaaaatttagtaatttttgaaactttgtgatttaatatatttatcagtgttcgaatttgagaatattgggttcaattggatctgtacatctactactacttctgagttatgactaaaagatcgagcccttgtgtcggtttgaggttctttagaaaaagaaaaagttaaaatgcatgtaatttctgcggaaaaatatcacatatttagcaaatctagacaaagtgaaaagagaaaagtaacgccaaactgtttacccataaaattatacagttgaatttgttatgtgatttatatacaagaaaactaatttgatcaaaaaatgataaataaacaagattgaaaataagacttaccggttaaaatcgaagaaaataacaagtctggctacgagagcattggctccgagtacataaataagaacaatgtaaaagagcaaataaagttatctgattaagcttgagaatgaaatataatataagtttttccctgaatttaatttcatccctttacaatagttgttcaacctactattcataactatacctagggaaacaagatcctaggatcaagcttttcttatatgacaataaatgggccattgataattatgtaacggcaggccatgaattcaaatattctctgcaacggttgtccatttaatgccagaaaatattcttcattgaatgctatctaacgacaaacattcaatctcccctcgtcaatcatgcttccttcgaggtctattcaatgccatccgcaattgttgctcccggcatgggttgttacttgatttacttaatacctatatttggttccacatgtcatgctaccatttgataatttaatataaatcaattttatcttatacactaaaggtaaggcgattcttatcaagaaattctctatatccaagactcgaacccaagatctctaatcaaagatcgaaggaatctccatcatcgagaggggcagatatgggatgttaattacgagttcatacgaatccaatggagatgtactctaagccgcttgcttcactgacccaaggtctatttacttcctccatctattagttaattttttttggttgtaaaaggtaactttattaataaactacgtaatattacaaaaggctctatcagccatcccactgggatcgaaactgatagggcttaccaaagtagtagagttttgcatggcattaacattgcccatactagctaacctattacaaacttcttccgaaatagacctagagtagtgttttcctcagcgtcattcttcaaatccgcctccacttcctgtgttggtgcatgatgaatgactgttttatttataaacattaacttcttactgcttcttgccaaaagatgagctacagagttagcttttcggaagttatgcctgagcattggtgctcctagttgtgccattaaccacctgcatgaggagataatgtgatcataaatttggtgatctttgtcaaatagggatattacctccgtggaatcagtttcaaattccaaaggataaaggttgaattgcaccgccatttgaagacctgcttctagagctagaagttctgcatgtgtgttgccaatgacaatagttattttttggtatcccactattcattttccatgactattacggatgattcctcccaatccacccatcttggtgttatgggtgtaggcactatcgcaatttaacttataaaagcccttaggttgtttgtgctatttgataggaatagtaacagatttcaaatgagtatgattgtcacccgttagatatttgaactccgctgctttgttgagagttagtgcttctgagattttattggagagattgttggcattgttgttattaggattgagacagatataccaaaggcaaaaggggtagacatcctcccatttgagggctttgaatgagattccaggatttagagatcgaatggagtctatccaatgaggataaggagttgatgggggtgggggggggggggggggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggggtggtggtgatgccaagttcccccaagaattattgtgcaatgtaacaatgtaaaaaaatgtggtagatgtcttccgtatttttcctataaactgtgcacacgtcatctatattaaggcctatgtgcatgagataagacctagtagggatttatttgtggtgacaaacccagataaagtagctaattttctcagaaattttgagtttccaaatccacgatgtgttcatgtcagtgtctttgggtggtgcaaggatttctatagcagattttatactaaaaactccattattggataacctccagtaggctctatcctttgcagtatttgaggtacttaagtaagtgctaaggatggtatttcgaatgtcagaaggtatgaaaatggagagcttgccaaggttctatttgtgattaacaataatatcaccaactaacatgtgatcctcgttactattaagggaaccacttattagggttctaaaaggtgggaggttgggaatccaattattgtcccaaattctaaccttgttcccatttccaattgtccaagtcaatcctctattgcaaagattgcaatcgttaatgatattccgccatataaaggatgtgttcttaggagagaccttattagagtattggctagtgagagtcctagcccaaggagtcataggattagtgaataaacaccaagtaagattagctattagggcttggtttttaacaatagctttaactaggccaagaccccctcgttcctttggcctagttactttaacatttctcgaaaagttatttaaagctaaaaaaaattgtattctcttttatttttcccttctttgaaaaatgtcgacaggcaaatttcctcctataatttagattaatctataacgaatactaatggcggtagacgaaatccccttcgccgaataattgtgttgtgcgaatagggaaaaaatttaattttttccggttatatactatatattgaatccttgtgatatgagagaagattttaatatagtggtaaaggggttcaaaaattaatttatttacatttacaaatattaggtatgaaagtactctagtatcttttaaattcccttatacagaggcagaactaggcggcgggaatgagattccgcagaatcgcttcgccgaaaattacaccgtataagattaaaaaaaattcaatatatatatatatatatatatatatatatatatatatatatatatatatatatatatatatatatatatatatatatatatatataaaatctccttaatgtttttagatatttacttttttcaattttgaatctccttgataaaaatcttgtttccgccacaaactaacgcgatgctttacataatcttttgacgccggaagcaacaatactgaggccaagggaatcatgttacatgtccactatttactgagaaattttggcagaatcattagacttggcaaagatttatcataggaaaagtaatattgtatagccgcttttaaaataatagccgatgtacgttatatacaaaaattatataaattttatacacttttttgactaccaaatataaataatttatggcgtggcctaaagtgataatattcttatattgtaactgttattcaacctgtaattatggcctttatgggcactgttgtgtcaaatgccaagcttttagattatactctttccatttcaatttatgtgaacttatttgactgggcatgatatttaagaaaataaaattgaatttgaggtgtaaaatgaggcacatatattttttctgactataaaccatagtataaaggtaaattattttcaaatatgaaaacggatcattcttttgacatcgattaaaaaggaaatatatttacgtaaattgaaatggaggactatatgaaaatcttattccgtatttagtcaaatttcaatatggatactaaagattgagtgaaaaaccttttaaaaaaaagaagactagtgccatggcccgccacattatcatgccatgtaggtaccacttagaatatattttttgtcacgaccctagttcactgccggtaaacatgtcatgatggcacctgaccggcgaggtcaggtaagccaattatactgcggaatttcaataattactgcaagaaagataaataaaacggaagtagataaaaatgtaataggtgccgcccggcacatacacttagcattaaaccttaagatataatatacccaaaacccggaaactcacgggcaacacaggctataacatttgaacatagtgagctctaatcatccgaaagtctaatacaagaggaaagtggaataacaactaaataactatagctggaacagaaggagatctagcaggatatgcggacgcggcagatgtatacctcaaatctcctggactggtaactccggactcaccgctgatgcgctgtgccggaagaccctggatctgcacaacaaaagtgtgcagaagagtagtatgagtacaccacagcggtactcagtaagtgccaagcctaacctcggttgagtagtgacgaggaaggtcgaggccctactgagataaatgcaataagataaagataggcaatataatgagagatgaaaacagtacgaagataaatatggcaacggtttaactagaactctacaagtactacaaccaaggaaaacaaggaataagcaatgcaaaataataatcgaaccaaaatatccaaaggatctcccaggatccctgtcctgtagtccttttacaactgtctcaatggatctcccgggataccaacccgtagtccaatatgtcaatcatatccggaggatcttccgggataccgtcccgtagtccaacatgtcaagcgtatccgaaggatctcccgggataccgtcccgtagtccaacataaccagtgcagggggagctaccggaatcccacatccgtagtcccaaaagtaaacaaacaaaggggatctaccggaatcccacatccgtagtcccaatgtaaatacgcagacatagtcaatgataataaaagactagacaagaatttaacaataataggaacatctagtctaacatgcttcatatactccaccgaaggcaaataagcagtcaacacagctaattaagactaatcatgcttttctaactatcacaagttaagctagtaatttacaacagtcaattgagcgataaaacacaatttgagaatttcaagtaaggtgaatttccaacaattggcacaagtgtacgcccgtcacctcgcacacgaggctttaaaaccaacaacaaacagtcctaagggtaaaggtcccccacacaaggttagacaagtcacttacctcaaaccggtaccaaaataaataggaagcaaagcccttgccacgagtatccaactccgaatggcccgaatctattcaaaccagttacaacgtataaataataatgcatttaactaattacactgataaaattgaagctacgacgcgaaaataggtaaaatgaccaaaatgcccctcaggccaacgtctcagaatcagaatattttcacattttcagaaacctcgcgctctcacgagtctaaccatataaaatttatcaaaatcggaggtcaaatggtccctcaaatccccaattctaggtctaagaacttaaccccaatttcatggcaaaatctgaaattaaagcttgatttcgagttaagatttgtgggaaatgatcaaaatagagtaaggaatcgttacccggtgtttgcctctgaaaaaccctcaaaaaattgctccaaaccgagctccctagcttgaattttgataaaaatggaggaaggttcgtgtttggatattaagtactgttccaggtctttaaagcatcgcgaacgcggtctgaccacgcgttcgcgtagaagaaatttttaagtgaccaaaaatgctcttcgcgatcgcgaaggagcagtgcgaacgcgaaggtctgggcttagcatggtacgcgaacgcgaaccagaggcgcgaacgcgaagaggaaaaagggaaggggtctgggtgagctacgcgaacgcgacgtggggatgcgaacgcggaaggggaagctggcaaggcttcgcgaacgcgggaagaccacgcgaacgcgatgaaggggagaaggcagaactacgcgaaagcggtactccttcgcgaacgcgtagaaggaaatgcttctgtgatttttctgcaacaattctaaagtgcaaacttctccgttgagcacccgaaacacacccgaggctctcgggacctcaaccaaacctacggacataccccataacatcatttggacttattccaatccttaaaccacccaaaacaacgccggaaacacgaattaatcattgacttgaacttagaaatttcaaaacttagtcaaaatcataaccgatgccgaaactaaccaaacgaggtccgaatgacctgaaaatttgcacacacgtcccaaatcacctaacgaagctactgccgctttcggaattccattccgagccccggatcagattttcacctatcaaccggatatttcaaatttccaactttcggcatttctaggctaattgagctacggatatccaaaatacgatccggacacgctcacaaccccggaatcacctaacggagctaacgggaccatcggatttccgttccgaggtcgtcttgacactgttccgacaacggaccattttccaacacttagactctcacataaggactatttgtccaaaattgctccgaatttgactaccgaacatcccggcaatacaaaatagcttaaacacacttaggggaagcagttaatgggggaacggggtacaatttctaaaaacgacaggttgggtcgttacatcctcccacacttaaatattcgttcgtcctcgaacgagcataaagaacatacctgaagtagcaaatagatgagggtaactgctgcgcatatcccgctcggtctcccaagtcacctcctcgaccggctggccccgccactgaactttcactgaggctatctccttagacctgagctttcgaacctgcctgtccaatattgccacaggctcctcaacataggacaagtccttgtccaactggactgaagagaactccaacacagagacggaactccatgatacttccgaagcatcgaaacatgaaataccggatgaaccccggccaaactaggaggtaaagcaagctcgtaggcaacctttccaatcttcctcaaaatctcaaaaggaccaataaacctcagactcaacttccctttctttccaaacctcatgacgcctttcataggcgaaacccggagcagaacccgctcaccaaccataaaggaaacatcgcgaaccttccggtccgcataactcttctgtctggactgggctgtgcggagtcgatcctgaatcaccttaactctctccaccgcatcctgtaccaaatctgtacccaatagtctcgcctcacccggctcgaaccagcccaccggagatctacatctcctaccatataaagcctcatacggcgccatctggatgctagactgatagctattattgtaagcaaactccgccaatggcaagaactgatcccaagaccctctaaactcaatcacacacgtacggagcatatcctccaaaatctgaatagtgcgctcggactgtccgtccgtctgagggtgaaatgctgtactcatggtcacctgagtacctagctcatgctgaacggtcctccagaaccgtgatgcaaactgaggacccctgtccgaaataatagtaactgggacaccatgcaggcgaacaatctctctaatataaatctccgctaaccgctccgttgaataagtagtacatactggaatgaagtgagcagacttggtcagccgatccacaatgacccaaatagaatcaaacttcttcgccgtcaacgggagaccaactacgaaatccatggtgattttctcccatttccactctggtatctcaagccgctgaagtaatccacccggcctctgatgctcagccttcacctgctggcagttgaggcatttagctacaaactcaactatgtctttcttcatcctcctccaccaataatgctgcctcaaatcctggtacatcttcgctgcacccggatggatagaataccgcgagctatgagcctctgccaataccaactcccgaatatcatcaacatcaggtacacagatccgtccctgcatcctcaataccccgtcatctccaataaacacatctctggcatcgccaagctctaccctacccctgagatcaaacaaataggggtcatcatactgtcgctcccggatacgatcaaacaaagaagaccgagagaccacacaagctagaacccgactgggctccgaaagatccaatctcacgaactgactggctaatgactgaacatccatggctaaaggcctctcagccgctggtagatatgccaaactacccaaactctccgcccggcgactcaaagcgtcggccaccacattggccttgcccgggtgatataaaatagtgatgtcatagtctttcaataactccaaccaccttctctggcgcaaatttagatccttctgcttgaagatgtgctgcaaactccgatggtcagtataaatctcacaaggcacaccatacaaataatgacgccagatcttcaaggcatgaacaatggcggctaactctagatcatggacagggtaattcttctcatgtatcttcaactgtcgggacgcataggcaatcaccctaccgtcctgcatcaacactgctccaaggccaatcctcgaggcatcacaatagacagtgtaagaacccgaacctgtcggcagaataagaactggggctgtagtcaaagctgtcttgagcttttgaaagctcgtctcacaatcttccgtccactgaaacggagcacccttctgggtcaatctggtcataggtgcagcaatcgaagaaaacccctcaataaaacgacggtaatatcccgccaagccaagaaaactacgaatctcagtcgcggtggaaggtctaggccaactctgcacggcctctaccttcttcggatccacccgaatcccctcactcgacaccacatggcccaaaaaggccacagaatccaaccagaactcacatttagagaattttgcatataacttcttttctctcaaggcctgaagcactgtcctcaggtgctgctcatgctcttcccgaatccgggagtaaataagaatatcatctatgaacacaataacaaacaagtcgaggtatggccggaacacactgtgcatcaagtgcatgaaggctgctggggcattggtcagcccaaaagacataactagaaactcgtagtggccataccgagtcctgaaggcagtcttcgggatatccggctcccgaatctttaactgatggtaccctgagcgcagatcaatattagagaatacccgtgcgccctgaagttggtcgaatagatcatcaatacgaggcaaaggataacggttcttcaccgtaaccttgttcagctggcgatagtcaatacacatgcgcatagagccatccttcttctttacaaacaaaacaggagcaccccacggtgaaacactggggcgaataaaacccttatcaagcaactcctgtaactgatccttcaactccttcaactcaggaggagccatacggtaaggaggaatagatatgggctgagtgcccgacaacagatcaatgccaaaatcaatatcccgatcgggcggcatgcccagaagatcagctggaaagacatcaggatagtcccgtactacagggacagaatcaactgaaggggtctcaacactaacatcatgcacataagccaagtacgcggcacaccccttctcaaccattcgttgagccttaagaaaagagataactctgctaggagtatgatcaacagtaccattccactcaatacgcggaatgcctggcatggccagcgtcacggtcttagcgtgacaatcaagaatagcaaaatggggcgacaaccagtccatgcccaagataatatcaaaatccaccatgtggagtaataacaagtcagctctggtctcaaaaccacggatagtaactaagcacgaccgatacacacggtccacaacaagagaatctcctaccggagtagaaacataaacaggagaactcagagaatcccgagctacgcccaaatatggtgaaaagtaagaagacacataagaataagtggagcctggatcaaatagaactgatgcatctcggtgaaaaaccagaataatacctgtgatgactgaatcggaggcgacagcctctgtgcggccggtcatagcataataacgggcctggcctccccctcgagggcgacctctacctcccctacccccgcccctagccggctgggcaggtggagtagcagctggagctggaattatagcctgagaactctgagaggcatgctgagactgtggagtctgagaaggtacacctctacccaatctgggacaatccctaaccatatggcgcaaatcgccacactcatagcaagctctgggaggacgtagcggctgagactgaccgggtcctcctctactagactgtcctctgtgagcaccccgcgcaggaggcgcactagaaactgggggtgcataatagggctcctgaggcctgggtgtagctggagggccactggctgaaggaagtgctgagtgaactgggcgacccatgtagccccgaccgtggtgacctgctgctggagtccgggtaccaaaatagcgactcgactcgcgagacctcttggcctccctctcctcacggtccctgatgtgtagaccctcaatcctacgagcaatgttcaccacctgctgatacggaatatccatctcaagctctcgggccatgctggacctaatagaaggaataaggccctcaataaatctgcgaaccctctcacggactgtggcaaccaaggcaggtgcatgcctagccaacctggtgtagcggatggcatactcagtaactgacataggaccctggcgtaagtgctcaaactccgcacgccaagcatctctgagaccctgaggaacaaactcatcctcgaacatagtagaaaactgagcccaagtcaaggaggcagcctgatccggactggacagctcaaaagtacgccaccagtcataagcagctcctcgcagctgaaaagccgcaaaagaaaccccgctggtagcagtaatacccatagtacgaaaaatgcggcgacagtcctccaaatagtccaaagcatcctccgtggccaatccactaaatactggagggtcatatttcttaaacctctctaacctcctctgctcatcctctgaggcaggtatctcatcctccggctgaaccggtgcgacaggctgaataggaaaaataccaggagcctgatcaacatgcactcgctgctctggagtgcgggcggcgggagtctgtgctcctcccccggcctgagaagtagctgtaggaaggggcaacagccctgcctgagataaagcagtgtaggcactcataaactgagctagtgcctcctgaacagctggagtagtagtggctgtgggcgtgtcgggcgtctgagccccgactggtacggctggtggtacctcagcatcagctcgcgcaggtgctctggctgcaccacatgcgtgtccacgacctctgccccggcccctacctctaacggctgcaggagggggtgcgggtgcctgatcatcctgggtcgcgcgtgtcctcaccatctgtgagagaatagaaagacagaaattagattggtgcaccaaaatgtcgcacgacaaggaattcaactgaagtgaagattttcctaaacagttacatagctcctcgtagacaagtacagacgtctccgtaccgatcagcaagactctaagcaaccggcctgtgttccgtgactcctatgaacctagtgctctgataccaacttgtcacgaccctagttcaccgccggtgaacatgtcatgatggcacctgaccggcgaggtcaggtaagccaattacactgcggaatttcaataattactgcaagaaagataaataaaacggaagtagataaaaatgtaataggtgccgcccgacacatacacttagcattaaaccttaagatataatatccccaaaactcggaaactcacgggcaacacaggctataacatttgaacatagtgagctctaatcatccgaatgtctaatacaagaggaaagtggaataacaactaaataactatagctggaacagaaggagatctagcaggatctgcggacgcgacagatgtatacctcaaatctcctggactggtaactccggactcaccgctgatgcgctgtgccggaagaccctggatctgcacaacaaaagtgtgcagaagagtagtatgagtacaccacagcggtacttagtaagtgccaagcctaacctcggttgagtagtgaggaggaaggtcgaggccctactgagataaatgcaataagataaagataggcaatataatgagagatgaaaacagtacgaagataaatatggcaacagtttaactagaactctacaagtactacagccaaggaaaacaaggaataagcaatgcaaaataataatcgaaccaaaatatccaaaggatctcccaggatccctgtcctgtagtccttttacaactgtctcaatggatctcccgggatacctacccgtagtccaatatgtcaatcatatccggaggatctcccgggataccgtcccgtagtccaacatgtcaagcgtatccgaaggatctcccgggatatcgtcccgtagtccaacataaccagtgcagggggagctaccggaatcccacatccgtagtcccaaaagtaaacaaacaaggcggatctaccggaatcccacatgcgtagtcccaatgtaaatacgcagacacagtcaatgataataaaagactagataggaatttaacaataataggaacatctagtctaacatgcttcatatactccaccgaaggcaattaagcagtcaacacagctaattaagactaatcatacttttctaactatcacaagttaagctagtaatttacaacagtcaattgagcgataaaacacaatttgagaatttcaagtaaggtgaatttccaacaattggcacaagtgtatgcccgtcacctcgcacacgaggctttaaaaccaacaacaaacagtcctaagggtaaaggtcccccacacaaggttagacaagtcacttacctcaaaccggtaccaaaatcaataggaagcaaagcccttgcaacgagtatccaactccgaatggcccgaatctattcaaaccagttacaacgtataaataataatgcatttaactaattacactgataaaattgaagctacgggcgaaaataggtaaaatgaccaaaatgcccctcaggccaacatctcggaatcagaatattttcacattttcagaaacctcgcgctctcacgagtctaaccatataaaatttatcaaaatcggaggtcaaatggtccctcaaatccccaattctaggtctaagaacttaaccccaatttcatggcaaactccgaaattaaagcttgatttcgagttaagatttgtgggaaatgatcaaaatagagtaaggaatcgttacccggtgtttgcctctgaaaaaccctcgaaaaatcgctccaaaccgagctccctagcttgagttttggtaaaaatggaggaaggttcgtgtttggatattaagtactgttccaggtctttaaagcatcgcgaacgcggtctgaccacgcgttcgcgtagaagaaatttttaagtgaccaaaaatgctcttcgcgatcgcgaaggagcagtgcgaacgcgaaggtctcggcttagcatggtacgcgaacgcgaacctgaggcgcgaacgcgaagaggaaaaagggaaggggggtctgggtgagctacgcgaacgcgacgtggggatgcgaacgcggaaggggaagctggcaaggcttcacgaacgcgggaagaccacgcgaacgcgatgaaggggagaaggcagaactacgcgaacgcggtactccttcgcgaacgcgtagaaggaaatgcttctgtgatttttctgcaacaattctaaagtgcaaacttctccgttgagcacccgaaacacacccgaggccctcgggacctcaaccaaacctacggacataccccataacatcatttggacttattccaatccttaaaccacccaaaacaacgccggaaacacgaattaatcattgacttgaacttagaaatttcaaaacttagtcaaaatcataccgatgccgaaactaaccaaacgaggtccgaatgacctgaaaatttgcacacacgtcccaaatcacctaacgaagctactgccgctttcaaaattccattccgagccccggatcagattttcacatatcaaccggatattacaaatttccaactttcggcatttctaggctaattgagctacgaacatccaaaatacgatccgggcacgctcccaaccccggaatcacctaacggagctaacgggaccatcggatttccgttccgaggtcgtcttgacactgttccgacaacggaccattttccaacacttagactctcacataaggactatttgtccaaaattgctccgaatttgactaccgaacatcctggcaatacaaaatagcttaaatacacttaggggaagcagttaatgggggaacagggtacaatttctaaaaacgaccggtcgggtcgttacatttttattatatgaaaagcttacatagaaaagaggctagcacttgtgagaaggttctagagaaatatagaggtttccttaggaagaccctagaaacctatgaatttgctaagaaagtccctagaagattctagttatgtagaaaattctagagaagggacttacttgtaaataataagggacttatgtaacaattaataattacacactagcccccatgagactaatatataaagagggttattcatttgtaagttgttgcgaccaaacacacacgtaagtatacgcggtcgtcaagtaataaaatgactaaaagtcggatgtcgatcccacgaggacttgtgattaactatcaactaaattagactatcctaattatctaaacaagaattgaacctagaagtatttgattctaaactaattaaataaaaagaaaataaataataaactctaaacaaaaggatagcagatttttatgttatcaatataatgaaaacgatctagggttatgggctatctaacattcctattgtactcttcaattgaattgactaattaatttatctagtttattggttgacagggttaatattgctcataagaatatgtcgagttcttactcgcctattcaagctaacctaacgcctatatgtctatggagttagaatcaacaagaacgcatttataattcctgtaaatcaaccaagcaaggcaattgggtatatgtctatcccaattgctaattcgttccccgaggcccaggttcaagaacttgccctactcaatcctatatgcaatctagaattcccactttcgagttcatttctagattcgtagatagtattcaattggtgatcaagcaatcaaataattaagcgcaagattgaataaataaaccaatatgataaatgaagaaatcaaactcaatattcgaataacaatagtcatgaaagaaacacaaccctagaacgtgaagtttagctccacatagacatggtagcaaaacaacaaatcatacaaagaaacataaaaattacaaagtttggaggaagaaaagatgaaacccggcctccacggcggctctgtgctcttccttggtcaaaattttttttagaaaatgttctcctatgtatatataccaagtagggttgggcccaaacaattataccttctccaatgtaaaaaaggacactttttccgagtcagacgcgcgagctcgcgcatacttcgcgaggtacactgtctcagccccttaagcgcgcgaactttgcgcgacttcgcgcgttcttcacgcgttttcaccctgttgcgttgcgaatttggaaacacacaaaacatgaaagttgtagccttttgagttagctttccaaccatatattgtggatcccaattggagttaggaacaaaacgttatgtctattttacttgatagtgcgcaatctgcctactggattcttcgttcgctctaactatcatccgttgacccccaaacgcgatctcggcttaatttattaagcttttactcagattttaaagctctaaatcacttgaattcattccataacatctatatatcttggaatcactcctacaaggcataaaacacacagttagtgaaagacactagcgattaaagctcaaactcaatcaaagtgcagtaaatttgagtgtaataagcgactaaaatacacaattatagcatatcatcaacaccccgcacttaaatcattgctcgtcctcgagcaatcaaactacactttatatagacacaacctttttttaaacaattctcctaactcatcacaccaagaatatttaaaatagattaagcacaaaagcgtaacatcttcacctcatgatttgactcacaagtaccacgcattatcactcgcccacttactataacataaaggtcactgaaattacctttccttcatgaatcaagtgccctcacacaacaaaagagagtagttccacacaataaaatttaagaacacttaggaactcaagattgaaagaatttactcactctcagaaataatattcatatgccacaaaagatgcaccataggcttgcccgtagtgtactactctactaatcgagctcattcagtctaggatcaagtaggactttatttggttataatgtaggctacgggacgggtaggatacgtttagatataagagtgaccacacctccctaagcactttaatacatgcattttaacattgaaaaccacacacttatgtcaaaccatatctccaccttcacattaatatatattaactccccacttctttaagcacaattatatcaagagccacctcttatcttttttcataataatccaactattttttttcttttctttttcaattcaagtggctcttactttttcaaaacagtgcacctttctccttattcaattagttccattcaaaagccaaaccaactaccccacactgtaatttttacaaagttcataacaattcaagtgctcatgagaggtgaaaaggttcaaatagatggttaattcaatcaaatgggtaaggcttgtaatgtggttgccaaagaaacaagattacatgctcaaagggcttaactataatacataataattaggcgggtaacatatacatatctggctcaacaaagaaatgcctatatcacttcaaagactgaacaaaactactatttcgctttgcaaacacacggggcaaaaactagacatcagatgcaatgcatagaataacacaagaccttacacacacatagcacataactcactcaggattggactcatcaagacactctagtcaaagaagttaagaaaagttaagatcatacaatttaaggtacttatacaagagtcaaaaactgagcctaagcgtcacaaccaaagtactcactattctcaaggcataaccaagtcaagagatattgcttcaattcaaagcacaacaccatggcttctctccttaaaaaaataaaactacctacacccggttcaaataaaacccttggaaaagaaccgtggcccaaagaaaaaccaaggaagagttactacactacctaagaaaaaaataatttttttttttcgtgttttctctagactaacttccctcaagaaaactatctaggagatccatcgtcgggaaaagtccattttttttcgtttttctaaaaaaaaaattattcaattaaactaacacaactaaaatagcatagaaagtcactcagacaatctcctcaccccacacttaaaattgtgcaatgtcctcaatgcacaccataaataataagagggtaaaagagactccctggtaggccaaaggccgaagaattagcagctcacgggatactcagacttctccccggtatgatcccttgtgcgggtacctcacacttagtttcaaccacctgctcgcttttgcacatgcctattggctttgactccatatgctcaaaatcctacaaaaaatgctacaaagatagaaaaataaaataaacaaaaataaattaaaaaaataaaagaaagcagtaaagctgggttgcctcccaacaagcgcctaatttaaagtcgcggcacgacttgaaccactttttgcctccaccttgaacttatgaattgtacccctaacatggcatccagtatgtggctatgctcctttggtagggctacaaagataaacaggccaagtaataaatttttcactctgcacttctcgccctttagatgaggaatgtaatttttgctttttggcacaacaaattcaagaatataggcgcactcatcctcaatcattgaccccttcattggctcagatggctcgattactatcttactatctaaacacaatgtggaaaaattattggaatgaggtctaatgcgctttaactcatgaattttactactatttgtatcctcatatttacacgcactcaagtctcccaaagtaatgttatctactccctcacatgactctagagcattcttctcaatattggcatcctcaagaaaaacagggtctagtgattggtattctcgttttagctcctcaatttggtctagaagatttttttcagcttcacacaactcatcattaaattattgggcgttacacgcattaacctttgcactcaaatctgcatctaagttacgcacagccaagccaaaattatcatatttatgtgcaagctcttctctctccttagaccaatcatttaccaacgttgctagaagacaacgtcgttttgcatattcgcctaagttagaatatctatcccagtaccaacctttactcccatattcaaattcagaccaccaagaggtcaggccatgacaagcccaaaaagatgggccataaaagtctaacattaaccaagcgttttcatcaataaccttatctccgaatatttcatccccagatgtcatgtttagagaactagaaacacactaagagaaaagtcaaatagttataaaattacaaatattcaaaaaaaaataagaaaagaaaaaaacctgtagagataaaagtaaaagtttaatttagaaaaatagttaatttctaagtccctggcaacggcgccaaaaacttgttgcgaccaaacacacacgcaagtatacgcggtcgtcaagtaataaagtgactaaaagtcggatgtcgatcccacgaggacttgtgattaactatcaactaaattagactatcctaattatctaaacaagaattgaaccaagaagtatttgattctaaactaattaaataaaaagaaaacaaataataaactctgaacaaaaggatacaagatttttatgttatcaatgtaatgaaaacgatctagggttatgggctatctaacattcctattgtattcttcaattgaattgactaatcaatttatctagtttattggttgacagggttaatattgctcataagaatctgtcgagttcttactcgcctattcaagctaacctaacgcctatatgtctatggagttagaatcaacaagaacgcatttataattcatgtaaatcaaccaagcaaggaaattgggtatatgtctatcccaattgctaatccgtttcccaaggcccaggttcaagaacttgccctactcaatcctatatgcaatctagaattcccactttcgagttcaactctagattcgtagatagtattcaattggtgatcaaacaatcaaataattaagcgcaagattgaataaataaaccaatatgataaatcaagaaatcaaactcaatattcgaataacaatagtcatgaaagaaccacaaccctagaacgtgaagtttagctccacatagacatggtagcaaaacaacaaatcatacaaagaaacataaaaattacaaagtttggaggaaggaaagatgaaacccggcctccacggcggctctgtgctcttccttggtcaatttttttttaagaaaacgttctcctatgtatatatagcaagtagggttgggcccaaacaattataccttctccaatgtaaaaaaggacacttttcccgggtcagacgcgcgagctcgcgcatacttcgcgcatacttcgcgaggtacactgtctcagccccttaagcgcgcgaactttgcgcgacttcgcgcgttcttcgtgcgttttcaccctgttgcgttgcgaatttggaaaaacgcaaaacatgaaagttgtagcccattgagttagctttccaaccatatattttggagcccaattggggttaggaacaaaacggtatatctattttactagacagtgtgcaatctgcccactggattcttcgttcgctctaactatcatccgttgacccccaaacgcgatcccgacttaatttcttgggcttttactcagatttcaaagctctaaatcatttgaattcattccataacatctatatagcttggaatcactcctacaaggcataaaacacacagttagtgaaagacactagcgattaaagctcaaactcaatcaaagtgcagtaaatttgagtgtaataagcgactaaaatacacaattatagcatatcagcataagttcaccaaacaaaacaatcaagttctctctaatataaaagctttctttggcaattttcatgtgttctaacattctcttagcgatctttagtgtagtaaggctgacttagcatagcaaaaacgtgagcaagttgtgcaaaatcgtgagcgggttgtcaagtgtcgcatgtgtacttagttaatgactaaggacgtgacaacggagtatcagaacaagggttatgactaaaggaatattagaaaaaatacaagagatcgctagcaggaagctttgtagggaaccatgatccggattactaagggcgtggtacttgcaaaagggacaaatatgaaggttccttagcaaaaggagtatggaggtgtatgggatgcacgcgaggtggaagacttattttggagaatggacaagtactttaaggtagtcaaggaggatggcgaagttgttaaggtacgcaatacctcaatgtacttgatcaaggttgccacgctatggtggcgtcgaaagtgtgttgacctggaaaaatggctatacaagattgagacgtgagagatgttcaagaaggagttgaacaagcacttctacccgatgaatatggtgtacgacgctaggcggaagctaagggagctccgacagacgaccataattcgagagtatgtgcataagttcactaccttaatgctgcaaatcccataattgtccgataaagatttcctcttctacttcatggatgagttgcaaaattgggcaaagcaggagttaagaagctatcaagtaaccagcgtggatagggccatagcggtagccgagccacttattgacttcaagatggaggctgccaagtccaaagaagtcaacatcgagaggggtgggagagatcatgacaaggacaatgggaaatgaatagccaaggtacacaagggcaatggcacaggggaatcccataatgaataggagtccaagataaatggcaaggggtcggaaaccaatagtgagtgcgtgcctaagggagggtgctacttctgtaaaggatcacatcaggcaagtcagtgcctagagttggggaagcttgcatcaatgatcggaaaatttgcttaggcacataagggtgacacaggagggaccgcctgcattgggggatgcgcttggaatctaagacaaaagtaggggattctaaagcctatcttggtgccatgcaaatggagaacagtggtagaaaaaaaagttgggtggacatagttaaagaggatgacgagttacaaagtgatggcacgctattagacttagacgatgcaccaaatagaggggtcaagttaactagcaatactgggactacagagggcatccaaatagggagtgaaagcatagacccgatgcttgacaagcttctagacttggttgagtcataagaagattcaggccaagatcaaggagaggcatccgatgggcgaaggatcgagaccatcatcgctagccgtctaaagtacaagcggggcaagaagagagtgacaagtagcttgtgacatggaaatgagaaccgctccatagagatatgcgcgcatgtgttgatgctttatgctgagggcggtacaaaatttggtggtggagagtctcttggcctgccacatcatcatgccacgtaggtgccgcttggcatatatttttgttatatggaaaacttacataggaaagaggctagcacttgtgagaaggttctaacgaaatatagttgtttcccttggaagaccctaaaaacctatggatttgctaggaaaatccctagaagattctagttatgtaaagaattctagagaagggacttactgtgacgacccaaagggtcatcacctgtttcttccctttttccgtacttctgaggccttgaaaacctcatttttaatcgcctcgatttacgtacgcagtccgggcgcgtagccggaaagcttatatgttaaattctgtgaaaatttgctaaaatttggtattaaaatggttaaagttgactttggtcaatattttgggtaaacggacccggatccgtgattcgatggctccgggaggtccgtaaaaaaatatgggactcgggcatatgccggaaatcaaaatccgaggtcacgagcccgagaaatgaatttttaaaagaaattatttttctgaaattaatatagatatttgaaatgaaaatggataagaacatgttggtatcgggcccgtattttggttccggcacccggtacaggtctcatatgtgatttaagacatttctgtgaaatttggttgaaatcggacgtcatttgacgtgtttcggacctaaatatctaaaaatgaaagtttatgaagtttgataataaagtgataattttgaggtttgattcctcgtttatgatgttattttggcgatttgatcgcacggttaagttcgtaggatattgttgagttagtgtgtgtgcttggttaggggtcccgagggctcgggagtgttttcggaggtgttcggggtggttttggacttaggaagatttcagattttatgcaacttttgaacatgcattttcttctttgcgatcgcggctttcagctcgcgttcgcactgcctgtcgtgtccccttcttcgtgttcacgttcaacttcacgcgtacgcgtagttccagcccccccttcaacacgttcgtgtattcattcacgcgtttgcataggccaaaatatgggaccccagtaattaattctacgcattcgcagtcccctatcccgaacgcgaggcttgccagttgcccttcttcgcgaatgcgacccctatgtcgtgaacgcatagggcattttttcccagtcattttaatgcttcaaaaacagaacagtgcatacgggttttattcaaaatttcacacgagctctcttcttctccaagctctaggagtccattgaagcccccactcttcaagaccatttgggttagtaaattcccacttattttctttattaattagtgagtttctaagcttaaatcacatagattaggatggaaactgggggaattgggtagagttagggcttatcaattttccttgatttagacctcgttttggggtcgagtttgaaaacaaattatatattcgggcttgtggggggatgggggatatgaaattggttcgaacctcgtattttgaccaagcgggccccgggtcgatttttttgaatttttggaagaaaggttgggaatctatatttaagcattgagtttgatttgtttagcttatattgatattgtaaagtcgtcgtttcatagatttgattgagttggagctgaattcgagagggaaagcgttcgttgtggattgatttagccgtggaagctgaagtaagtgtttggtctacctttggcttgagggaataggagtagagtattgtttgctaattgcttattgtcgagtacggtgtataggcatggtgacgagtatctatacaccggtgtctagtgttgatacccaatttttccatatgtattttatatactcaaaatatgctcaaaataacatgtatatgcatatataagcatacccaagcattttggtatttttccaaaatttttaaagatttttaaaaccaatttactatttattttagcaatacaaaacccaataattattccccaaattatcatctttggtgaataacttattctattcttataatcgcaccaaaatataattaaggtgattttgcatattttctgtaaacttatttgatattcctaagctaaaattgcataaattgcaattatagcctatattgcggttgatagcatcttacaattacaaaattgcttccagtatttttagattaacacttatatattattaattaattcagtgcttttaatttgtttttaaaactattttaactattttaattaaatcaaaaaagggaaaattggctatttaacttatagcccatttacatttcaatcatagccacattacagctccaatttgaacccattttcaactggcccatttcaaaactaaccctacccacaaccctttaaagacaatatgcccggatcccttacctacccattcaatccagatcgttgatcattttgatcaacgaccaccttttacccttcaataattaaacccaaacgaccccctaacctaagtcattttccaccaacccgctgccctaatatccctctactctctgattctctctgaggccaagacgcctccctccgattaccacctgaaaccgcctgaatccatggcttccaaagccattaaaggcctgtacttgcctcctatggctcctgcatgcctgttgttcgaatgatcgaggctagacctcgagggtcttcactcagaccttcacctattcgaggattccggacatctccggccttgctccggtggcttttggtcttttgagcctgattatgacattatccgacttagatcggatattctcgaagcctttctcgtctcttgggttcatctgaaaccctaactatcgaggttctccctgattatttttagatctgttacatgtttgcactgttgcttaagtttctttaacgttttctctgattttctctcaaacgtcacttcttttcgagtagggtttctggaagattcttaaaatgttttgactcttcttcttcttcttctccttttcttggtgtgaatcgatccctgctatgttattatttgctctttctgactcgcatgttttcttcgtgtgttcttatatttgctgtattataaaattttctgttgtgctccgttctatcttctactggtttcaatatcatactctcacatgcctatcttatgtgtttctttacagtgtttttctactgagttttattcctttgttgcctttaccagattttgcctggattctttctaaatgtgtttcattgactgtttatttgagtttacactacctgaactcatttaaactccaagcttttcttgaaacttgtttcatgtactagtttctatgttctattcgccttgaacttgctattgtgcttgtatgcttttcatgagacttcgaaagaggtctctaagtctgtctcaataacttgccttctcgtctctgtatcaaattcgagtttttttaaaaaaaaaccctaggatttgggggtttctttggcaaatttggttacatgtttttaaaagggttctactttgaaactttgaaccctcagactcattccgagtttatgaattgaatttgaactttttctgcgtttgtgaatttcaaacttttcttgctagtctttcgtaattagcatgacctcttcttgcttgacatgtctatgtgttttatatatgagaacttctcttcaaaggtttcgccaactgttaaattgattttgaatccctttattgttgcttatttgattgttactgattttcctctaagttaaaactttccattacctcttttctgacttgaacaagattttcgatatggttcttttactagctgttttactaattccctttccttgttttcacaaatcaagtaccaccggactttttaccttaaatgtcttctatgtatttgcccttatttgtctgttatgcacaacatatttacttgatctccttccttaaataacttctgcccattaccgttcaaatttgaactccttaattaaagaaaagtccatatactgattgattttaattggtacatagttccataattacctctaaactctgattcttaccttatttgcgacacctgttttcaattataaataccctgctctttcattaacacagacacgattcttaagcatatagaaatcacaattctttcctaaaaacctagacttttgcttcttgattgcactttggctttcataagtcttctgttgctccatacttgcttctttgaactggtatgtgctacttttgattctagcagcaaatccaatgtgtttatttacaagcctttacgcccatgcctactttactgctatgtagaattcaattttaaagtaactacttgtgtattgctatctgttgctataatgaatcactatccccatccccttttatgtgcttgggctgtagtttaagacatggcaacatacaaagttgttgtcatggattaagactagaccctttgggtcctaagctttttcaatttcccatccccattccctttatatgtattgagttaaggctttggtctgacagtatcctcattactacccaggccatggcttgaccttcaataggtcctgactctccaatgtttggctagcaggctggtcagggtgggccagcagtccagttgctgggaatgaccaccaggctgccctggctccccctaattccctttcattgcacttatacttactcctagtctctaagttctgcccccttcttatgagccttgctttgggaaccttgagttccctctgaacttggacatttaaaggatggcccttccacactgcaccataatctgttctgcaatgttatttggggtgtaagcactgcctggaactcttgaagtttcttggaactctgacacatcccaaataagagaaaggctttggaaactgatcccgaaagttggttcatctcatattgatagatattgagtctaaataaggttccttggatgcagcttaaatttctgatgtattttttctgtttgattcatttggtctgtaataatttatattaacttatggggtttagtaaagaaagggagggttacttactgtatgcataagggtagatatcatgttcattaggtatttacttctgcaaatcatgtcaagttctacatttctgcatctagaaatcctattttaggttctgcactttcatatagaaatcttgttttaagttctgcatttctacattcttcatgtagaaatcctgttttaggttctgcacttccacatttttcatatagaaaccctattttaaggttctgcacttttgtattttggaaatcctgcctataagttttgcatttcatacatagatcaatagttctctacatttctgcatctcacataaaaaaacatacctataggattttgcattttgcctatcatatagaaagcatgtctatagggtttctgaatactatatacgtatctatcattaggcaaaagatttttaggcttaaacaataatcaattgcattctagatatcatgctcgtaggatttctgcattcttgttgtgcatgtaaaaagtgtttaaaattaacaatgctagaaagcatgcctgtaggagctatcaatcaattctgaatcgcctcactcgtttaagtttaatctgtcagtaataacgcgttatcaactgcaaaacttgattattctattaaaattggcaacctttctgtaaccaatttacttctttttctgaaaccagtagatatcatgtctattggtttcacctaggcaagccttaaggtaaaagctgtaactgcatcagtcttcaataattgtagccaggcggacctaatgcgaacttcttgtctgaaaatatgtgatgaaccagtccgcttaacatttaagtttaattcagacctaatcagtatatgtaaggcatgctaaactacatgttttttttctgtgattctgaggaggcttatttgagcatttacttgttatgtgcacctcataactgtcctatatgttttgtttgacgcattagaattttaacctttctaaactcttgaaaaatcccaaaaactccttcccttgataggactagaagtcccagatgccttcgggactgataagattgggacgggtactagcatgcaataagtaacgatactattacgcgatataataccttaacgaggtgggaagggtagaatatggatatgatgaccggtgcgctaatatcacgtacaacccctcttttgaggagtgtttgacgtgtattgcactgatgtgatccatattaatcataaacctaggacccattttcctttgtttatctttgtttgctttctttagaactatttaaaacctttcaaatttctactttatttctacttacttttcacaagttttcaatttgttgtaatatgatatgtaaacccttatctgagccttaattgtttatgtgtttatatatagtcacaattgtaacatggccgggaccacactagtggatcttgaggggtgcctaacaccttcccctcgagataatttctagcccttaccctaatctctggttccttcatttcaaacccttcttaaaagtgtacaaatgcactataatcatttggcggtgactcttcaactccaaaaacccaattctcaaaatggaatagagttgtcctcccaaatgtcgtatacccgatttcgccttagaaaaagggggcgtcgacagcatggcgactctgctgggggtttctttaggcttttaccattgcatgctactcgtgactttattatcactttaattgcccttacttactgtctttatttcctttactatgaaactaacttggctcttcgtgtcttttctctcctttaattctttcttttactgatgtacttcaatactattgtaattacgagcaactattgtaatcattatcttatgaacgtggaaatacatgccaatctgtttcattcttgtaatttcatcttcaacatcatattccacttgtgccaaacaaataccatagcaacgcttataatgagtggttgtgctcttccgatattatcacccctaaattcggcaaaggcatattcgcgataaaactagttgatcagcggtgcagtcgacggttccgtgcctttccctcttgagttgtccgctcaagggtactggtctaataccccatagaaaccttactctgtttaactgtacatgcatcatggtcaaacctagccgagtcagttatgttgtccacatcatgactctttaagacagcctcgtccaaagtccaccgggtttccttgaaacccaaatggacgccaccatgttctgtgcatttatttggagaactaaatgctcattatgctaattattggtttaaatagtcgagtctggtggggtaagggtctaacactttgttttgcagaaaatgaggcacgaagtccccagattcggcatggtaaccaacatccacccaaggtttcttagctggtgggaatatctccatgcaagtaatcgaactctcatctgcaagtacatagggaatctgccttctcttctggagatgcgacctgacaacaaaatcatagaggctgcaactctgttctgagatagtgatagatccgtgttccgcttcggggaccttgaaatgactcctttgctcgaggaaataggaggattagctagtattccttgggagaatccgggtttgattatgccagaaaatcgcaaaggtaggggtttcctcaagatgatgggactaaagaaaaacccagacttaagctgtttgaaggactcttacatcccattcgactatttatacgagaggtacgtccatagcaagtcataccgcacttacccagatgaatttgcccttacttccttggggcatatccacagaagagtcttcgtctttatgttctactttttggggatgatagtattccctatgaagaagactaggatccacaccagactagccatggtaaccaagactttgatggaaggaattggcgggcaatctttcagcatagtacctatgatcgtcgctgaaatgtatcgggacctgaaaaactgtcaatgaggggccaaacattttgagggttccaacttattactccagttctggcttatggagcacctccaaaagggcgaataccggtaagagattctgcgtagagactgggatgatcacatcgccttccatcagccaaagcaaatgaattatatgcctaacatgttcgctcagccagctggaggatgggtagagttatttaagcatctgaaagaagaccaagtgcagtggatgttcgagtggttccctagggaagaattcattgttcgctcccgagacgcaccattcctcatactcattggtctgaggggaacatatccctatgtccctctccgagtcacgaggcaggcaggaagaaaccaaatcataccaagggtcgacaagatgagtcacttcagggctaacttccaggacaatgatagccctcacaagagccaagcttagcacatgtggcagtgcaaaataatcttggggaaagattctattgagccagataggtatcacgccggctgtgtaccacacaattcgggttggttggaagaaaatcactatggtttgggtcaacacgggttcattcgaggtcacagggtcatcgataaaaaggctgaagcacgggttaagtacaactaactgtgcaagagaatttgggaatgtgaaagtgagcaccgagaaatacaagaagcccatcagaagctgatcgacgagtggaaagatacggctgtcagcaccaacaagcgactagggtatttggagcgaggtctagtagagctggaaggaaagttcataaaaaggatcgatgactgtcaaaatgctaagggaaatgcgggcagacatctagcccgagcttatctgctgctaagactgcgcgagctggtaaagctgttcgagggagataaaaatgccgaatctggggaaggtctttctgggaccaagtagttagggggtcttttcttttgctttaatgatgtaataaggccaatggccattagtgatattttactttttgctatttagtgtcattttgggattcgtcttatttttatcaataaaatgaggcatttagcattataagttctccaaaattaatttgtcgctaggcctacctcgggcacaacgaggcacccaaattaggacacgatttaaattcttgcacaatgtgtttaaatactgcaatatttcttttcataatccgcactaacttattaccttttatttttcttttatttttattcccctccccaaaggttaatttgtgcactctgacatcatcatcatactccacaagatccaagggccctccacctcctcctcctccaagtcctatccggaacaagaacaagggaagaatgggagatgcaagcaccagaaaggaaattgaaagagttgagattcctcagggtaccccggtttccaaggaaactgcttcccagctcgaacaaaagttattaaaatttcaagaagaattggaccaagttcggaacttagcaagcttatcattttctcacaccgctccgaatgtcaattttcctaacacccaaaaccccgcaccttcacagaaaactgcacaatcacagaaacaacccactcatacttaacattgcaacacatgccacactcccaacaacactccattactcattcttgaaccactgaacaccaaaaatgaccatctccacaacacccccatctgcgtggataccgtaccccactacactcaaccaatctcaagtgcacctgagtctgatgacaaagactccctcatcagaaacttggccgcagaactcaaaaggctaactagctgagtccagggtgttgaaggaagcaaaggtattggttgcaagtgcaacttttatttcataattcaaatttcaaacttacaaaatgaaatgtttacatttttctaataagtaaagtaatctagtaaagtagtaatttcaaatgttttgcatcgccctagcaagttcatcataatcaatatgaaccgattgaccttcttccggcgtgttaaattcggatggatttccatgtgttaatatatctccaagttcctcgtcttctgggctatcaacatctgcctttccttgatttcttcgttcggatcttatccaatctctgaaacatactaaaacttccaaagcattgcttcccaatgagtgacgggtgtctccaagttgttgtcttgcttggctaaatgcactctccgatgcaacagtagaaattggcacattcagcacgtcccgagccatagcgaaaagaacaggaaattgctttccattttcatgccaccatcccaacggtgaaaattcctttgtgcgaggctccttttgattctgcaagtagaattgaagttcatcaatattcctgctacttgtttgagtgttagaaaatgtagaaaaaatattaaaactatcaaagccttcttcatcatccacagtagcagaagtgctacattgcatagcgggattaacatttccagaagcacgagcagcattatcacattcatttgcataataattatatagttgtcgtaaatattcatttagatttttcatagaggcatataaagttggggttttagtttctcgaatctccatgtaagtatataaagcattcattaattggtggtaatcagacattttaatagaaggatttaaaactgcaccaattaagtaaatcggaggaattggaaagaaatattttttgaatttttcttgcattttttcaacaacatccttataattatctttcttcttaaattcagagagtagaaaagaaatttcagctatatgtactaaagtcatagtaacagtagggtaatatgctccagaaaactcaacagtagctgtataaaatttatgtaaaaatttaacaacatcattaatgacctcccaagtatcacttgttaacatacgcctaggatcagtacaatgtgcattagcaacttcagttattgggaatctatatttgtagcaacattttaaaaataaatatgtataattccatctagtaacaatttcgtctggcatgaatctaggtttaaggttatactggatacatttatccttaaattcttttattctagattgtctattatttccttgaataacaccaactgctcttctaacacgagtaatctcaactgaaaataaatctaggccacttttaacaattaaattataaacatgacatgcacatctaacatgaaaaatatcttcaagaggtggttgcaaatgcaattttaaaattgaaattgcggcagtattgttagaagcattatcaaaagacatacacaatactttttttcctagattataaaattcaacaacatcaacaatagtactacttataaacgcagcagtatgactctgatcttcatcatatttaaaagcgataatacgtttttgcatacaagtactatcatctatccaatggcatgtaattgtcatataatcatttccattaacatcatggccaatatcagaagttagacatactctagatggaaggtggctaaacaaataacgtatgtatgtttgatattgtccatgcagtctaaagatatctgctctacaagtacttctagggatacctttaaataaaggattataaatcctttgaatatacataataagatacgatgaagaagcaaaagaaaaaggtagacaacccaaagcaatcatttttgctaattcctcacgatccctcattttatcatattttactagacctccagtattatggttaatagttgtttgattttcatccccatcagtgcctcattctatgggatggtcagctctcatatgtctagtaatcgtcccagtcccccctaaatttcctcagtcaaatgtttaaaacttttcttacaaattttgcatctaactctatcagtaccttctactacttcaaaaaaattccaaaccttacttcgttttctacgattagaagtcggagccacaggtggtctaccagtagcactagcaactctaactccaacactaccaactccaccactagtaggtgtaggtggtatctcattttctattccataatcttcttgtaattgttgataatatatatctacattatcattaggcgatgattcagaaacatgtgtaaatgataaacggttactaccggaacctgaaggactatctctttttttacttccacccctaccagtaacttttctacacactcttttagcagcattcaacatattgtaaaaattataaagtataagctaaaattaaatatgcaattaaaaaattaaataagagaaatagttggagggagtgcaccgaattcgataataaattgagcacttaattacgcaattcgggtgttaccacgaacaaacgtcaaccaagtatttcaattttgaagttcaagcttcaaattccgaatgaaaaattccgataaattaaattcacgaaaagagagccaaataaaattagaagatgaattgaaattaaggaataattcaagacttcaagtcttgaaagttggagaataagagaatgagattatgagagaattgagaatttagatagataaataaaatttgagtgagaaatgaagaagggaagggggtatttatagttttttgaggttgtatttgtaaaataaaaaaaagggtaaaataattaaaaaaaggccaaaatggtcgttgccaaaaaagcccaaaatggcctaaacggtaaagagtctttactaaagactaaagttctgaagaaatcagtgaacgttgcccaacgttcacttacatggggaccccaccgcgtcagattttgatttatataaaaaaaatgttgaaccgggccgggccggtccagttaaccggctacaaacactgttcatacggaccaggctcaaccggtccggttaaccctttcaaaaaagaggcacggaccaacccctgacccccaccaacccagcccagcccagcccctacccaaccaggccggccccatagacagtcttaatatatagtcgccggactatcccgatgattgggggaagaaggagaataggcggagaaacctaccaccatattgaaagagtcaacgccgtggacaaagataaatggtgggataacaagattgaaaatatcctgaattggtgcagatatgaacctgggaaagggcttgggaaaaacctccaaggaattgccaaacccatcaagctgaagaataaacatggtaccacatttggtttggggtatgaatacacttgggaggaattcaaccattggtcgccaccatggcgcggtccctactatccactagagcatccgatacctcgtttggagaagactttccaaccggcagacatcgtatatgggttagaggaagaggcattagctgcaacgaggaatctgtttcttgaggacgatgatatgggctgctgtgttatcttcgaggaggaaagggaggaaggcccttccctacaagctgtgaaccggggagaacgcctcaataattggtcaatcagaaccactagggcccgtaaagcttcgaggtatcaaggctaaacaaagcaccatgcatcacattttactttactagctgattttctttccgtattgtctttaatttttgaaaagagctatgatgttcaaaacaattatgaaatttaatcaaagcattcaagtttattatttatctcgctattattattttctctaccatttactttatttacacaacattattattacttacaaattcgtttggtatttttaaaactaaaatgcatgtgattacaatactagcctctttaagatttaatagcattttataattataaaattagctccagtatttttaaattaatatttatatattattaactgattcagtacctttaatttgctttttaaaaattttactatttttataaaataataggggaaaactggctatttcaattgtagcctcaattcatttcaattataaccacaattccatttcaatttcagcctaaaatcaatctaattatgaaccaaattggaccagcccaatccatttaaaccccgaccctgacccaattaccaaacccgcccggttttgtattttaaatcccggccgttgatcattttgaccaacggctctcatccaccctttcctttttttaattccacctacccccaaccctaatccccatttctcttagacagcccccccaaactctcttctctctcaaacgctctcaaacactcaaaaccctaatcgcctccatcgtcctctccgaccaatctcaccggagtccatggcttctcaggccatggacagcctgtgctcaccttccttcacttctaaaccatgggtattcaagatttcgaggtctgacctcgatggcgtccgttcagatcctctgcagatctgtggttctatggcctctccggccctgttccgacgtgttcaagatttagaagcctagccatggccatctctgactcgagaccagacctcttccaagccttcttatttctagggtttcagagaaacttttctagggtttcatagaaaccctaaagctattcgaggttccttcctcttttatttacctagatctgtggtgaatctgtgctatattcaacgttttaagctttttccccaattttccttttcaaaattaatttgttttcgatttagggttttcgaaaaatcttaaaacgacttctgactcctcttcttcttcttcttttcttttgtgaatctgtatgtaccatgttcttatgagtttttctcttgtgttcttatgttttgccatattatgcatgttcttctattttgtgttctgttcttcctctactgggttctataagcatgctttacatgtctatctcgtatgttcctttactgtatttttactaagattttaatccttgttttcctttactggacctttgttcgaactctaagtatgcttatttactgtttcctaagttatacatgacctcttttctcttttaaaacttacttaaattccaagttttcgttaaaacatattctttatgttttttcactctgtttcctcaaacttgctattgtgtctgtgtgttttctcgtgaggctctgaaagagacctctgagtctatttcaatagcttgccttctcctctttgtatcttactcgagttggaaaccctaggatttggggttttcgatgagtttgatttgatgttcagactagggttctattttggaaccctgggctctctcaaactcagtctgagtctatggaatgaactcgacctctttattaggactctaaatcttttctatatgatgttttcttgtttgtgcatggctgtgtgctttttatatgacaaagtctcttctctcaaaaggcctttggccagcttgtgattgattccgagttccttttttaaaaggtttgattgtgtgttgttgattttctttaaattaagctcctcttcacctttcctggttgggttcattcgtacctagaccccaacccctgattttactggctgttgattgattgtctttccttgttctgcctaaatagcgtaccactaaactatttccttaaataaacttctgtgtatttgcccctgttatactgctttagaaaagatttttaaaacaaatcctttccttatttattttgcacgtttgaatcaaatcccttaaccaaaaggaaacagcttgtgattgatttcgaaactattcccttacctttttcatacttgtcttctgcactataaaaggggctaccctttcacaggcttgactgacttgaatactaagtttctcacaattaaaatcctactctcttcttccctatacttctactctgtgctttctgaaacaattttgagctctctctaaactctcaagtgttatgctgaacttaagtctacccctgctgtgttcacttgtcgtgatagctctattgttctgcttgttttacttggcaactggtatgttgtttttagttaaataatgcttcttcactatgtgtttacttcctagtctgttatgctttccttcaccatgtgtttatttcctagtctgttatatatgttttcctacactatgtttctgccattactgtgcttatgtgaattccttttcctttttccctttgtatgtgagtgtggttacagccatagcagcactttaacattggtgtctatgactctgaacggggttctttgaaacccccctaactcaaatcaattcccactcccatctcccctttatgtgtttgagcttgatctgggtctggtggtgtcctaatcactatccaggctctggtctgaccctcaaaggtctgctcctaacttgtttgaccgaacaaatggtcaggggtgtgccagtctgcatctgtggctgggtatgaccaccatttgttatggctccccaattcctttttcactttgcacttactcctagctctatgttccgcccctctcttgcaagccatgctttgggacccttgagctccctctgaacttggatgcctgagggttggctattccacactggactattcaaattctaaaggtatcctgggtgtaagcaatgccgggaatccttgatattccttggaactttgaaacattttggataaagagaaggctttggaaatctggattccggaattggctaatcacatgttattagacattaagattgaattaggctgctcgaatctagctgctagtctttaatgtatttttttttacattttctggtttgtaataatttgtataatgaacttggggaatatagtaaaagggtgtgggaggggtcttactttcttgcatcagtaagggtagatatcattccctaggactttaattttttactagaaatcctgcctataggattgttcaatatttctgattccacatcgtatagataccatgcctatagggtttaacgttaatcatatcgcaaatcactagaaatcctgcctatgggacttttaaacaaattttttctgaaaattcacatatagataccatgtctatagggattgcatactcattaggcaaactatagggctaatcaaacaatcatctttttatcagttcaataacaggctctaaaaaaatcagtaacgtagacatcatgcctatatgattttgcatcaaactcgtttgattcgcttaaagcaacaatgatctattaaatggtccttaacatcttaatacagtaattttttcaaaatccttaatcctttgacaaaactctcttgaaacagtacacttttgagttcctcaaatcggcatcttttctgaaacagttcctttctaaacattctgcctaaacgtgttttactcagtccctgaaattgtctttttaaaacattcttgtagcttactctttccttagatatttctgtctctgaagctctttcacaactatttttgtgtttttatactctgacagactgatgattctttttactcatttctcaacttactgcagtctatactttctttcaaaactcttctgcattagactactcttctgaaacgagtactttctaaatcactcgcttaaaataccttattttctaacaattggatccaagttgcctaatgcagactttctatctaaatatatgtgttaaaccagtccgttcgttgtttaagtttaaacaacaaatcaatatgtgccaagtcatgctaaactaagtgtttgtttgatcaaggggtttacttgagcctatttgtcgttcatccctatacttgttacttgtttttcatgtcgaaattagaattttatcctttgaaccctatatatgcctctatccctttcttcccctttaggattagaagtcctaataccccgggactgatagtttgggatgggtactagcatgcagcaagtaaacgagactaatcgcgtttaaataccttaatgggtgggaagggtagaatatggatatgatgaccggtgcgctaatatcacgtgcgacccctcttctgaggagtgtgcgtcgggtattgcattgatgtgattcatattttgtataaacctaggacccctttcccttttcttgcaaatgttttctttaaattatgttttcttcaaataatctttttcctaaaattgtagtcctttccttttctttaagctttcaaacttatttgtgattcttatgcgcaaactttatttgtttcttctattttcttaaagtcaccattataccatggccgggaaccacactagtggatcttgaggggtgcctaacaccttcccctcgagataatctctaagcccttacccgaactctggttttccttcttctcaaaaaattcttcatctctttaaactgtcataatgcactataatcattaggtggcaactctccaaatgccgaaacccaattctcgcaagggaataaaagagttgtccttccataatgtcgtatacctgatttccggacacccgtccatgataatggaaaaagggggcgtcgacagcatgttgactctgctggggatttctttaggctttttaccattacatgctttttgtgaccttattgcttcattaattgcctttatttcttgcctttaattgtttcatcacgaaaactaacttggctcttcatgtctttcctttcttttaactgctttcctttactgctttattattatactgttgtaatttcgagcatttattgtaatcatttatttttatgaatgtgaaaatacatgtaaacttgctttattcttgtaactgcatcttctgcatcatactccactcgtgccaaaaacaaatcctatagcaacgcttataatgagtggttgcgctcttccgatattatcaccccctaaatgtggcaaagacatatttgcggtacaaccagtcgatcaacggtgtactagacggttccgcgcctttccctattgagttgtccgctcagggctacttgtctagcacatccaaaaatagaaaccttattccgttaaactgttcatgcatcatggtcaaacctagccgagtcagttacgttgtccgcataatgactcattaagatagcctagtccaaagtccatcggttttcctagaaacccaaacggacactcccatgttctgtgcatttatttggagcactaaatgcttattatactaattgttgatttaagtagtcgagtctagtggggtaagggtctaacgctttgttttgcagaaaataaggtatgatgtccccagattcgttatggtaaccaacattcacccaaggtggctaagctggtgggaagaccttcatgccagtgatcagactcttgtccgcaggtacttaggaaacctaccttcacttctggaagtccggcctgacaacaaaattatcgaggctgctaccttgttctgggatagtgatcggtcggtgtttcgctacggggaccttgaaatgacccctttactagaagaaataggggatgtagccggtattccttgggagactccaggtctacttatgccgaaaaatcgcaaaggtaggggcatcctcaaaataatgggactcaagaagaacccggatctgacttgtctgaaggattcctacataccatttgacttcttgtatgaaaggtttggccatagcaagtcctatcgcacctataccgacgaatttgcacttacctctttcgggcatatccacgaaagggtttttgtcttcatgttctgtttcctggggatgatgatctttcctatgaagaaggctaggatccacaccagactagccatggtaactaaaaccttaatggaggggattgatgggcaatctttcagcatagtgcccatgatcattgccgagatatatcgagccttggaaaaatgccagcaaggggccaagcactttgaagggtgcaatctgttacttcaactttggcttatagaacaccttcaaaaaggcgattaccgataggaaatcatatgcagagattgggatgaccatatcgcttttcaccacccaaagcgaatgaacttcatgcctaacatgttcgctcagctagaagacgctagacgatgggtagaactattcaagaatctgaaaggataacaggtacagtggatgtatgagtggttcccaaccggggagttcattgttcgttctcgggatgcacaattcctcacactcattggtctgagggaacttatccttgtgtccctctccgagccatgaggcaagcagggaggaaacaaatcataccgagggtagacaaaatgagtcacttcagggctgatttccaggacgatgatagcccgcacatgtgtcaagctcagcagatgtggcactgcaagctcgtcttggagagagaatctattgagccagacaagtatcatcccgggtgtgtgccgcattattcaagttggttggaagacaatcacactggtttgggtcatcctgggttcgtccgaggacacaggcttattgatgagaaggccgaagtgcaagtcaaatacaatcaactgcgcaaaaggattcaagagtgtgaaaatgagcaccgggaaatacaggaagcccatcagaagctgatcgacgaatggaaggacatggctgtcaacgccaacaagcggttagggtatatggagcgaggtttagtagagctagaaggaaagttcttgaagaggatcgaagactgccagaatgccgagggaaatacaggcggacatttggcccgatcctacttactgctagattgcgcgagctggtacagctgtacgagggaggcaagaataccgaatctggggaaggtccttctgggaccaagtagttaggacctttttatttcttgctttcataatgtaataaggccactggccattagtgatatttttattatacagttgttttaaggctcgtcttgtttttattaataaaatgagtcatttagcattataagttctccaaatttaatttgtcgctaggcctacttcgggtacaacaaggcacctaaattaggaaacgacttatattccagcataacgtgtttaaatatcgtaatattttctttctcataacccgaactaactttttaactttgtttttcttttatttttattcccctctccaaaggttagttcgtgcattctggcaccatcagcatactcaacaagatccaagggccctccacctcctcctcctcctcggagtcctaccagaaacaggaacaaatgctgaatgggagatacaagtgctagaaagtagatttaaagggaggaaacttctaagggaaccccagttgctatgggtactgttgcccatcttgaacaaaaattgctaaaattccaagaagagttggaccaagttcggaacctggccagtctatcattttcccttgccgctcctgatggcaactgtcaaaatcccacaccaccacagaataccccacaaccacaagtaccacccaccactgctcaaacctgctatgtatgcaatgacactccactgctcattcccgagctaccaaacactacaaacgaccacctccacagcactcctatttttgtggatactatacctcactatacccaaccaatctcaagtgcatctaaaccagaagacaaagactccctcatcaggaatttggccgctgaactcaagaagttaactagccggatccagggtgtcgaaggtagcaaaggcgttgaggggctgaactacgaagatctttgtgttcagccggatgttgaactcctggaggggtacaaacctcccaagttcgagatgttcgatggtacaggtgatcccagggtccatatgagaatgtattgtgataagctggtaggagttggaagagacaagaaaatccgcatgaagctgttcatgaggagtctgaaaggcgacgcattatcttggtacgtcagccaagattcaaagaaatggacaagttgggtgagcatggcgtccgactttatggaccggttcaggttcaacacagagaacgcaccggatgtgttctacattcagaatctgaagaagaaacccacagagacctttcgcgagtatgctactcgttggaggtcagaagctgctaaggtcaggccagccctagaggaagagcagatgaacaagttctttgtccgggctcaggatccgcaatactatgaaaggctaatgctgatagaaggtcagaaattctccgacatcatcatgttgggagaaagaatcgaagagggtatcaagaatggtatggtcactaatctcgaagcgttacaggccaccaacaaggccttatagtctggtggcacgttaaagaaaaaggacgtgaattccgtaatggctgcacaaagaaccaaatctcctatgaaataccaaacatatccctcaactccactcacatatcaaccttacctaaattacccagcaccctcgcccacataccaaattccaccacccacctacaattcatctccaccacccacatatcagcccacctcaccgagatattcccaacctgcattggtgtaccaagcatataactcccaaccttctcattacccatcaccacctactcgccaaaactttcccagacctcgatcgaaccataactccagccgattacattacccctatcccagccataactccagaaaatccctcccaatgggtcaatccgaacaaaacttgcgcataccattccagaatgaaaggccataccatcgacgagtgtcgctcgttaaaagacaagatttagaccttgattgataataaggtcatcatagctaaggatccctctcctaatgtccgcaacaatcctctgcctgaccacaagggcagaggcattcatatgatcgagattgaggatgattgggaccccaaagagtcaatcagattgattgttgagggggatgagctgaagaagccaacggtcaccctcaaccccattgttgtcctgctccagccctctgagggtgatgaggtaaatgtgtttgtaccactcgagttcgaagcacctcctgcaaaggcgccgggaccaattgaggttgagtttgggatcccaaaagcacctgcaccatttgaagttgttgtgctacctccaagggtgcctattctggtttcaatgatagacgtgacctcgttcaattcgagcgtcataccttgggattacacagcggaagctaggagaaaagggaaaataaagactagggaagcgatcgctgtgcagggcatgaccagaacaggcaggatatacactctagagaatttagctgagtccagcaaacaagcctttggacggcctattaaaactggacccgatgacctttggagaaagatacaggccaaagaatactcggtcgtggagcaattgaacaaaataccagtgcagatttccatcctgtctcttctgcatagatctgaggcacacaagaatgctctaatgaaaatattgagtgaggcgtatgttcccggcaacataactggggacaaaatggcaaatatggtaggacaaatgttagaaagtcacaagatcaccttccatgaggatgagctaccaccagaaggactgagtcataacaaggcattgcacatcaccgtgcaatgcgaagattacttcatcaccaaaatcttggttgatagaggatccagccttaatatttgtccactaataactctcagaacattggggaaaggtttgcatgagatcaaagatggagctatcaatgttaaagcttttgatgggtcccaaagatccaccattgggaaaattagcctgtgtttgtagatgagacctacttggtttgatgttgactttcaagtaatcgacgtcccagcatcctacaatctgttgttggggcgaccctggatccacgctgctggagctgtggaatcattttacatcaagcggtaaagttcgaatggaatcaccaagaggtgatcatttatggcgacggtagcaaccccatatacagtcgccagaccatcccgatgataggaagcaggaggagaataggtggagaaatataccaccacatcgagcgggccaatgctgtggacaaagacaaatggtgggacaacaagattgagagtatcctgatttggagcggtatgagcccggaaaaggacttggcaagaatctccagggtatcaccaagcccatcaagctgaagaaacatggtactacttttggcttgggatatgagtatacatggaaagagtttgatgactagtcgccaccatggcgcggcccatattatccgttggagcaccctatacctcggttggagcagactttccagccggctgacatcatataaggatcggaggaagacggagcattagcaacgatgaagaacttgtttctgtaagatggtatggactgttgtgttatcttcgaggaggaaggggaggaaggcccttccatacaagctgcgaatcgaggggaacaccttactaattggtcggtcagaaacaccaagacccagagagcttcggggtagcaaggctaaaacaagcaccatgcatcgcatctttactttttactagttgattttttctctccgcattgtctttacttttgaaaagagctctgatgtttcgaacaattatgaatttaatcaaagcatttccaaagtttattatatatctcgctcttattatttctctataatttactttatttacacaacattactatggtctatcttgatgatgaaccaatgactgtgacttgcaatgagacaatgcaacaaatggatatagagtcagaagaggatgatataccagaagaggctgtcagaggggttgagaactttgagaatatgctaaatctaacttggatgaaactgagattgttagtttggggaataccgagaatgtcaagaaaacgcgcatcagtgtgcacttatcgccatcagaaaagaaagagtacaccgagttcctaaaagagtatgaggacatatttgcatggtcttatgatgatatgactggtctcagcacatccattgtagctcacaagttgccaacagatccgacatgcccaccagtgaaacagaagctcagaaagttcaaacccgacatgagtttgaaaatcaaagaggaggttaccaagcaagtcaaaaccagggttctcagggtagtggagtatccaacatggttagccagcatcgtgccagtaccgaagaaaaatgggaaagtgagagtctgtgttgactaccgggatctcaaccgggccagtcccaaagatgacttccccttgccgaatatacacatcttgattgataactgcaccaagcatgagctgcagtcgttcgtcgattgttttgctggataccatcagatatggatggatgaagaagatgcagagaaaatggcgttcatcacgccgtgggggatgtattgttacagaatgatgccgtttagattgaagaatgctggggccacctacatgagggccatgactaccatttttcatgacatgatacataaagaaatcgaggtgtatgttgatgatgtcatcatcaaatccaagaaagccgcagatcatatggaagacctgagaaaattcttcaacagattaagaagatataatttgaaactgaatcccgctaagtgtgcattcggggttcttgtcggaaagttattgggtttcattgtgagccgccggggaataaaattggatccgtcaaaggtcaagtccattcaagagtttctaccgccgaaaaacaagaaagatgtgatgagttttctgggaagactcaactatatcagccggttcatagatcagtccaccgtcatttgtgaacctatcttcaagatgctgaagaaggatgccgccaccaaatggactgacgattgtcagaaagcttttgacaaaattaaggagtacttgtcaacgccgccggtcttggttccgcctgaaccagggagacctctattgctctacctcgcagtactggatggagcattcagttgtgttttaggacaacatgatgaaacggggagaaaggaacaagcaatctactacctcagcaagaagtttaccccgtacgaggcctggtattccttattagaacgcacctgttgtgctctgacctgggtagctcagaaattgaggcattatttctgtgcttacaccatttatctcatatccaggatggacccgctgaagtatatcttccagaaacccatgcctactagcaagctcgccaaatgacaaatcttgctaagtgaattcgacattgtttacgtcacttagaaggtagtcaaaggacaagctttggcagaccatctcgccaagaatcccgtgggaggagaatatgagccactaaagacgtatttccctgacgaagaagtagctttcataggagaggacattgcagaatcatatgatggatggatgatgttttcgacggagccgcgaatttcaaaggagttggcataggagcagtcctggtatcagaaaccggtcagcactactcggtatccgccaagctcaggttcccatgcaccaacaacatggccgagtacgaagcctacatcttagggctcaaattggccattgatatgaacatttaggagttactagtgattggagactcggacctactcatacatcaggttcgaaaggaatgggcaaccaagaattctaagatagtcccttatctgtatcacatacaggagtttaggaagagattcacaaagaccgaattccagcatgttcccagaatacagaatgagtttgctgacgcactagctactttgtcatccatgattcagcatccagacacaaatttcattgatcctatccaggtcaatatttgtgatcaaccagcttattgtgctcatattgatgaagaagcggataaagccttggttccataacatcaaggaatacctggcaacaggagaatatccagagcttgccaatgccactcaaaagcgcacacttcggaggttatctaataatttctttcacagtggaggaatcctgtacaggaggactcccgattaggggttactaaggtatgttgatgcaagagaagcaaccaaactattggatgaagtgcatgcatggacttgcggaccacacatgaatgggtttgttttagcaaagaagatactccgagcaggatacttttggatgactatggaaacggactgcatccagtatgtccgaaaatgccatcactgtcagatacatgcatacatgataaaagagccttcgaacgagcttaatgcaacaagttcaccatggccgttcgccgcttggggaatggatattgtaggaccgatcgagcttgccgcatcaaacgagcacaggttcatcttagtggcaattgattactttaccaaataggtcgaagcagcatcgtacaaagcagtgactaagaaagtcgtggcagattttgtccgcgaccgtatcgtttgtcggttcagaatttcagaataaatcatcaccgacaatggttccaatctcaatagcgacttgataaaaacaatgtgtgaaaccttcaaaatcatgcacaagaactctacagcctgcaggcctcagatgaatgacgccgtagaggcagccaacaagaatataaagaagatattaaggaagatgatcgaaaggcataagcaatggcatgagaagctatcatttgccttattaggataccaatccatagtccgcacatcaaccagggcaacaccttacaggttggtttacggtacagaggcagtcattcccgccgaggtagaaataccctccttgagggtcatacaagaagcagagttagataatgtagaatgagtaaaaggtcgctacgtgcagttagcccttatagacagaaagagaatgaatgtagtctaccacggtcagttatatcagaacagaatgtctagggccttcaacaaaagagttaaaccaagaaagttcacaccagggcatctattgttgaagaaaatatttccacatcaagataaaggcaaggggaaattctctcctaattggcagggtccgtacatggttgactggttctaactggacgagcccttaatcttgcagaaatggacggagaagtctggccgaagccaatcaattcagatgcagagaaacgatactatatatgatcacatgattcttcatgatgttatttgaactacgcctgatctgattcccgtttaagaggggatacataggcagccctacgggtttggtcacattttaataaaaaatccatttttcccccgctattggaactggggcagaattttgaggaggaccctcaaaattccgaagtcagtttttcagtctcttcatcgccggaagcgccaacccagtaaactggggcagaattttgaggagggccctcaaaattctaaaatcgatccatttccattcattcagtgcagccaccagaacaccaactcagtgaactggggcagaattttgaggaggaccctcaaaattacaaaggaagcaaggtcgcaatgtattgagccacattgtggtcgttggtacatccgaaagaaaaatctttttcaaatatatacttacgttttatttacaaaatcacgcataactatcatttgaattgtcgtcgtttagcaacactaccccagcgatacgtgacgtcaggagccacgggaagacaaactaaccttcctccctctacagaactcacgatttttctttggatgcaggtcacaaatcatctgaatacattcacacactcgtactttttaagtggaagaccatcagaacgatcacttattcacaaatttactatctacaaccaacatccccagcagccacgatatcgtaatcagctatcatctaagaaaatctcaccactattcactttttacattcttgcattgctgcataaggctacttatctgcctttcgagactaagcattgtctccatctgtatttttgcataaggctactcatctgcctttcgagactaagcattgtctccatctgcatttttcataaggctatctatctaccttccgaggttaagctctacctccatcctgcataaggctacttatctgcctttcgagactaaaattgtctccatctacattttttccataaggctactcatctgcctttcgagactaagcattgtctccatctgcatttgcataaggttatctatctgcctttcgaggttaagctctacctctatcctgcataaggctacttatctgccttccaaggttaagcattgtctccatctgcattttttgcataaggctactcatctgcctttcgagactaagcaatgtctccatctgcatttctcataaggctatctatctgccttccgaggttaagctctacctccatcctgcataaggctatctatctgcctttcgagactaagcattgtctccatctgcattttttgcataaggctactcatctgcctttcgagactaagcattgtctcgatctgcatttcgcataaggctatctatctgccttccgaggttaagctctacctccatcctgcataagtctacttatctgccttccgaggttaacctctacctccatcctgcataaggctacttatctgcctttcgagactaagcattgtctccatttgcatggctgaaatatcgcaaccttatttccggatagctgcaatatcgccacctgcatttaaattctcgctttggccgaaagatcgccaccctttgcatttatttgtctgaaagattgccaccttttcatgggctgaaagatcgccaacttcttcaaaagtgtcatagttcggaggcaccatctgcatagcccgagaaaaccatttcatggcctgcgaatttttattttatgctcttcatggcccaggacatcacagtatgaggacgtcttcctaaccgtccaaagacaacattcatggtccaacgggaacttgcatcatgtttaaattatgcacaatagacgctacattgctcacttgcaagtacaccggctagcaaacgaccgtctcagcaggagcgattccactccggttctacgcagcctatccgactccaaacatatcttttcaaacctaagcgtcgcgtccgttctttttcaaatccccaatcggcatattctgccaatggttcctgaactacatatggcctgattcctgtaaaaccaaggatatgtaggcagctcagaagctagagcttggtcaaaattatttccaatcgccgatctggtcaaaattggccatcttatttttacccgacaactcctccatcctctttggggaacatcgtgccagttgttgatacccaatttttccctatgtattttttatacccaaaatacttccaaaataacatatatgtgcatatataagcacaccaaaaggttttggcatttttaatgatttttaaaccaatttatggcctattttcacaccataaaattcaataattatttccaaaattatccttttggtgaacaatttattttatccttatatttacatcaaaacatagctaacatgattgttgcatatttttacaaattcgtttggtatttttaaaactaaaatgcatgtgattacaatactagcctctttaagatttaatagcattttataattatcaaattggctccagtatttttaaattaatatttatatattattaactgattcagtacctttaatttgcttttgaaaacattttactatttttataaaataatagtggaaaacgggctatttcaattgtagcctcaattcatttcaattataaccacaattccatttcaatttcagcctaaaatcaatccaatttcgaacccaattggaccagcccaatccatttaaaccccgaccctgacccagttaccaaacccatccggttttgtattttaaatcctggccgttcattatattgatcaatggctctcattcaccctttccttttttaattccacctacccccaaccctaatccccatttctcttagacagccagccctaaactctcttctctctcaaacactctcaaacactcaaaaccctaatcgcctcactcgtcctctccgaccaatctcaccggagtccatggcttcccagtccatggacagcctgtgctcaccttctttcactgctaaaccatgggtgctcaagatttcgaggtctgaccttgatggcgtccattcagatcctctgcagatctgtggttctatggcctctccggccctgttccgacgtgttcaaactttagaagcctagccatggccatctctgactcgagaccagacctcttccaagccttctcatttctagggtttcagagaaaccctaaagctattcgaggttctttcctcttttatgtacctagatctgtggtaaatatgtgctatattcaacgttttaagctttttccccaattttccttttcaaaattagtttgttttcgatttagggttttcaaaaaatcttaaaacgacttctaactcctcttcgtcttcttcttattcttcttttctttgtgtgaatctgtctgtacaatgttcttatgagtttttctcttgtgttcttatgttttgccatattatgcatgttcttctattttgtgttctgttcttccctctactgggttctataagcatgctttacatatctatctcgtatgtacctttactgtatttttactaagcttctaatccttgtttgcctttactggacctttgttcgaactctaagcatgctcatttactgtttcctaagttatacatgaccttttttctcttctaaaacttacttaaattccgagttttcgttaaaacatgttctttatgtttttcaactctgttgcctcaaacttgctactgtgtctatgtgtttgctcgtgaggctctgaaagagacctctgagtctatttcaatagcttgccttctccactctatatcatactcaagttggaaaccctaggatttagggttttcggtgagcttgatttgatgttcagactagggttctattttggaaccctgggctctctcaaactcagtctgagtctatggaatgaactcaacctctttgttaggactctgaatcttttctatatgatgttctcttgtttgtgcatgtttgtatgctttttatatgacaaagtctcttctctcaaaaggcctttggccagcttgtgattgattccgagttcctttttaaaaggtttgattgtgtgttgttgattttctgtaaattaagctccttttcacctttccttgttgggttcatttgtacctagaccccaacccctgattttactggctgttgattgattgtctttcctcattctgcccaaaccgtgtaccattaaactatttccttaaataaacttctgggtattttcccctgttatacggctttggaaaatatttttaaaacaaattctttccttatttattttgcccgtttgaatcaaatcccttaaccaaagggaaacaacttgtgattgatttcgaaactattcccttacctttttcatacttgtcttctgcactataaaaggggctaccctttcacaggcttgacagacttgaatactaagtttctcacaattaaaatcctactctcttcttccctatacttctactttgtgctttctgaaacaattttgagctctctctaaactctcaagtgttctgctgaacttaagtctacccctgctgtcttcacttgtcgtgatagctctattgttctgcttgttttacttggcaactggtatgttgttcttagttaaataatgcttcttcactatgtgtttacttcctagtctgttatgctttccttcaccatgtgtttatatcctagtctgttatgttttccttcactatgtttctgccattactgtgcttatgtgaattccttttcatttttcccctttgtatgtgagagtggttccagccatagcagcactttaacattgctatctatgactgtgaactgggttctttgaacccctccccccccccccaactcaaattaattcccactcccctcccctctttatgtgtttgagcctgatctgggtctggtggtgtcctaatcactatccaggctcaggtatgaccctcaaaggtctgctcctaacttgtttgactaaacaaatggtcaggggtgtgccagtctgcatctgtggctgggtatgaccaccatttgttatggatccccaattcctttttcactttgcacttactcctagctctaagttctacccctctctttcaagccatgctttgggacccttgagctccctctgaacttagatgcctgagggctggctattccgcactgcactattctaggtatcctgggtgtaagcaatgccgggaatccttgagattccttggaactttgaaacattttggataaagagaatgctttggaaatctggattccgaaattggttaatcacatgttattagacattaagattgaattaggctactcggatctagctgctagtctttaatgtatttttttttttacattttctggtttgtaataatttatataaagaacttggggaatatagtaaaagggtgtgggaggggtcttactttcttgcatcaataagggtagatatcatgccctaggactttaattttttactagaaatcctacctataggattgttcaatatttctgattccacatcgtatagataccatgcctatagggtttaacgttaatcatatcgcaaaccactagaaatcctgcctatgggacttttaaacaacttttttctgaaaattcacatatagataccatgactatacggattgcatactcattaggcaaactatagggctaatcaaacaatcatctttttatcagttcaataacaggctctaaaaaaatcagtaacgtagacatcatgcctataggattttgcatcaaactcgtttgattcgcttaaagcaacaatgatctattaactggtccttaacgtcttaatacagtaacattttcaaaagccttaatcctttgacaaaactctcttgaaacagtacacttttgagttcctcaaatcgacatcttttctgaaacagttcctttctaaacattctgcctaaacgtgttttactcactccctgaaattgcctttttaaaacatttctgtagcttactctttccttagatatttcagtctttgaagctttttcacaaccatttttgtgtttttatactctgacaaactgatgattctttttactcatttctcaacttactatagtctatactttcttttcaaaactcttctgcattagactactcttctgaaaccagtactttctaaatcactcgcttaaaataccttaatttctgacaattggatccaagttgcctaatgtagactttctatctaaatatatgtgttaaaccagtccgttcgttgtttaagtttaaagaacaaataagtatgtgccaagacatgctaaactaagtgtttgtttaatcaaggggtttacttgagcctatttgtcgttcatccctatacttgttactggttttgcaagtcaaaattagaattttatcctttgaaccctatatatgcctctatccctttattccactttaggattagaagttttaataccccgggactgatagtttgggacgggtactagcatgcaataagtaaacgagactaatcgcggttaaataccttaacagggtgggaagggtagaatatggatatgatgaccggtgcgctaatatcacgtgcgacccctcttctgaggagtgtgcgccgggtattgcattgatgtgatccatattttgtataaacctaggacccctttcccttttcttgcaaatgttttctttaaattatgttttcttcaaataatctttttcctaaaattgtagtcctttccttttctttaagctttcaaacttatttgtgattcttatgcgtaaactttatttgtttcttctattttctaaaagtcacaattatagcatggccaggaaccacactagtggatcttgaggggtgcttaacaccttcccctcgagataatctctaagcccttacccgaactctggttttccttcttctcaaaaaattcttcatctctttaaagtgtcctaatgaactataatcattaggtggcgactctccaaatgccgaaacccaattctcgcaagggaataaaagagttgtccttccataatgtcgtatacccgatttccggacacccgtccacgataatggaaaaagggggcatcgacaccagtgccaaagaaggataggaaagttagagtctgtatcgactaccgggatctccaccgggctggtcacaaagacgacttccctttgccaaatctaaacattctaattgacaactacaccaagcatgagctacagtcatttgtcaatgtttttgctgggtatcatcagatatggatggatgaggaggatgcagagaaaacgactttcattacgccgtggggaatgtattgttacaaaatgatgccattcgggttaaagaatgttggtgccacctacataagggccatgaccactatatttcacgacatgatacacaaggagatcgaggtatatgtagacgacgtcatcatcaaatccaagaaatccactgatcatatgggagatttgagaaagttttctaacagactgagaagagacaatctgaaactgaatctcgccaagtgtgcattcggggttcctgctgggaaattactgggttttatcgtgagttgtcgaggaatagaattggatccatcaaaggttaaggccattcaagaattgccgtgccaaataacaaaaaggacgtgatgagtttcatggggagactcactacatcagccgattcatagctcagtccactgtcatctgtgaacccatctttaaaatgttgaagaaggacgctgccaccaaatggaccgatgattgtgagaaagcctttgacagaatcaaggaatatttatcaacgccaccagttcttgttccgcccgaaccaggaagacctctactgctttaccttgcaggatggagcattcagttgtgttttgggacaacatgacgaaacggggagaaaggagcaagccatctactatctcagcaagaagttcaccccgtacgaggcccggtattctctactagagcgcacccgttgtactctgacttgggttgctcaaaaattgaggcattatttttaagcctacactacttatctcatatcaagaaaggacccgctaaagtatatcttccagaagcccatgcccactggcaagctcgccaagtagcaaatactgctaagcgaattcgacattgtttacataactcagaaggcggtcaaaggacaagccttggcggatcatctcgccgagaatctcgtggacggagaatatgagcctttaaagacgtattttcctgacgaagaggtatctttcataggagaagacattgcagaatccaatgatggttggtagatattcttcaacggagccgaaaatttcaaaggagttggcataggagcagtcctagtatcagaaatcggccagcattactcggtatccgcgaagctcagattcccatgcaccaacaatatggccgaatacaaagcctgcatattagggctcaagatggccattgacatgaatgtttaggaattgctagtaatcggagactcagacttgctcaaacaccaagttcgagaagagtgggcaaccaagaattccaagattcctccttatctacatcacatacaggagatgaggaagagattcacaagggcataatttcagcatgttcccagaatgcataatgagttcgctgatgcattagctactctatcatccatgatccaacatccagataagaatttcattgatcccatccccgtaaagatttatgatcagccagcttactgtgctcatgttaaggaagaagcgaacggaaaaccatggttccatgacatcaaagagtacttgacaaaaggagaatatccagaacttgcaaacgctactcagaaacacacctttcggcgattgtctaacaacgcctttcacagtggagaaatcttgtacaggaggactcctgatttgggattactaaggtatgtcgaagcaaaagaagcatccaggttattagacgaaatgcatgcagggacctgcggaccgcacatgaatggttttgtcttaacaaagaagatactccgagaagggtatttttggatgactatggaaacggactgcatccagtatgtccgaaaatgccatcgttgtcagatacatgcagatataataaaggtgcctccaaacgagcttactacaacaagcttgccatggccattagccgcctggggaatggatgttatcggacctatcgagcctgccgcatcaagtgggcatagattaatcatggtggtaattaattattttaccaaatgggtcgaagcaacaacatataaagcagtaaacaagaaagttatggaagactttgtccgcgaccgtattgtttgttagttcggcgtcctagagtcgatcattaccgacaatgggtccaatctcaacagcgacttgatgaaagcaatgtgagagaaattcaagatcaaacacaagaactctacagcctacaggcctcagatgaatggagctgtagaagcggccaacaagaatatcaaaaagatattaatgaagatgatcgaaaggcaaaaataatggcatgagaagttatcactcgccttattaggataccgcaccacagttcgcacatcaaccggggaaactccctatatgctagtttatggtacagcggcagtcattcccgccgaggtagaaattccttccttaagaatcatacaagaagcggagttagatgatgcagaattggtaaggagtcattacgagcagttggctcttatagatgagaagagaatgaatgctgtttgccatggccaattgtatcagaacagaatgtccagagccttcaacaaaagagtcaagccaaggaagtttacacctgggcagctggtgttgaagaagatttttccacatcaagatgaagccaaagggaaattctctcccaactagcagggtccgtacatggttcaccgggttctaaccggaggagcccttattcttgcagaaatggacggaaaagtctggccgaagccaatcaattcagatgcagtaaaacgatactatgtataaccatttatgattccctttgtaatgtaatttgaactatgcctgacctaattcctgtttaagaggggatacgtaggcagcccttgggttcggtcacaatttaataaaattttcatttcccccgttaatggaaactggggcagaattttgaggaggaccctcaaaattccgaagttgatttttagccattcatcgcacgcagccgtcagaagagccagcccagtaaactggggtagaattttgatgaggaccctcaaaattccggagtaaggggtggttgcaatgtcttgaaccgcgtcgcaatcgtcgtttcatctaaaaactattttcaattatatacttacgttatatttactaaatcatgcataactattatctgaattgctgttgtttagcgatgctaccccaatgatacacaacgtcaggagccactggaagacgaactaaccatcccccttttacataactcacgatttttcttttgatgcaggcacttgattcgcaatatcgttaggtatatttatgcactcatactgtcactgcccaaatcccggtcgcgatggcacccggccgcaaggctgggcaagcccgaccacaagaactcaacaccggtattacaacccaacaatgaaacagtaacaagaagtttaacagcaattttataaaataaactacccagtcagggccaaacagtatgaaagagatagaaaattccacaaaagatccccaaagaccaagggtcacgagcactgagcctctaccagaagagatacacaagtctagaagtgaaatacaatttctgaactgaaatgaaatacatgtccgaaagtactagaaagagtgataaggatcggagaagagggtcctgcggacgctggcagctacctctagtctccgtcaagtctgaatccgatagcaacagtagtactaaacctcagcagctcctgaatctgcacacaaggtgcagggagtatggggtgagtctaccaactcagtgagggataaatgtatataaaaacccgaaagctggaaaccgcagtaaagcacaatgtaaagctatctacacagtctcagacagaatagttcaaatatatccagataagcaacagagaatataagtataaatgctatgcaatgcaatgcacatgtccgctgcggtacgtgcagcccgatccatttgggtacccgcgctcactgtgggggttcagactccggaggggatcctacagcccaagcgccatatcataataataccgctgcggcacgtgcagcccgatccatatcagtccaagatatgcatgagagtcgctaaactggttcttttatagatttttaattccatttataatgaaaaccatgttcaagtcataaaaccttagaaatcgtgatctatgcaatttaaaacacagtgactagattcaggactgacattcaaataataagcaaatcttgctagtacggtcatatcaatccctgaaggattcctcaagtcggcacatggtcccaaacgtagcttcaagcccaggtatcatcaatatagaaagcgaagcgatcgctaacacggtgcaatttatccctcgaattgggaccgagtcacatttcacaacacatacgactccgctctaccctggagtgcgtgtctagctcacaatagcatcacaatgtgataaatcagggtttcgaaccctcatgtaatcatctacacccattactaacctcaagccggccggaaactagcccgaaatgacttttcctttcaaattcacctcttcgagcgacgaatctggccaaaaccacaacgaatacattacataatgctaatggaacataacccaatcgaaagaactcgaaaaataactcaaatcgcgaaattagcaaaacccgagccccgggcccacgcctcgaaatccagaaaactttataccaaaatgaccctcgtctcgccacgagttcatacatataaatttcatcaaaatcggggtccatatgacccctcaattcctcaataaaaatctagttgggtttcaaaccctaacctccatttttagcttcaaagaccttgatttctaggtgtttaattcatgatttagcagcataatcacatattagaagtctactagttcacacctgaacaatccccttgataatctctccaaaatcgcccaaatatcgccaagtctgaagctctcttgttccccttttcttttaatgtttataccctatgaaattttaaaacctgctcgacttccgcttaagaggaccttttccgcttcagcggtcgtcggttaagcgaccaattttccgcttctgcggtttcttccatttcctcagcgtccgcttctgtggtcgcttgaccgcttatatggtcccgcttacgcgacctccaaatccgcttacgcgattcctgagcttcccttgaccgcttctgcggtcgactatctgcttaggcggtcaccgcttaggcggctcttctccgcttaggcggaaacaccagaagtagactccgtttttcagccttaattccaaaaatcctccgattaaccatccgctatcaccccgaggcccccggaacctcaaccaaaaacataaactcacactaatacttcattcaaacttgttcgggcaataaaaacactagcttaaacatcaataatcatcaaaattacaaaatcaaagcctaagacaacatgaacttctcaaattcccattcgatgacgaaaccatccaaacgaagcccgaaaaatctgaaaatttgcaaacatactcataatcacctaacgaaaccaatgccactctcggaattccattccggccctcggatcaatttctcacctatcaaccggattccttcaaaaatccctattcgccaaactaagataactttcacaccgaacctccgaattcactttcgttttctctcctaagttacaattcagcccccgaaactagtcgaaccctcggaaatccgttccgagctctccaactcataagtcaacgtcgagttgacctttccaactcaagcttctcttaaagagactctttaactcattcttatccaattccaacccaaaccatttcaaactcaccgaatacgcacaacaacacatggggaaacatatgacggggataacggggctgaaatataagaaatgacaggtcgggtcattacatcctccccaactaaaacaaacgctcgtcctcgaacgggtcaagaaacatacgtgaagcagtaaacaagtgaggatatttgctctgtatctcctgcttggtctcccaagtagcctcctacacgggacgacctctccactgaactttaaccgatgctatatccttagacctcaacttgcgaacctgacgacccaaaagggctaccggctccacatcataagtcaaatcatcatctagctgaatcgaatcgaagtccaaaacatgggacgggtcctcaacatacttccgaagcatagaaacatgaaacaccggatgaactcccaacaacatgggtggcaatgcaagcttataggccacctccccaatcctatcaagaatctcaaaaggacctataaatcgaggactcaactttcttttcttcccaaatctcataacgcctttcataggcgataccttcagcaagaccttctcaccaaccatgaaagataaatctcgaactctccgatctgcataactcttctgacgcgactgagctgtacgaagtcgctcctgaataaccttcaccttctccaaagcatcctggaccacctctgtacccaataatctagcctcgccgggctcgaaccaaccaaccggagatctacaccgcctcccatacaaagcctcatatggcgccatctgaatactggattggtagctgttattgtaggcaaactctgcaaggggcatgaaatcctcccaagaaccaccggagtcaatcacacaagcccgcaacatatcctccaaaatctgaatggtacgctcggactgtccgtccgtctaaggatgaaatgctaaactcaaattcacctgagtccccatctctcgatgaaaagcccaccaaaactgagaagtgaactggggacctctgtccgatacaatagaaactggaacaccatgcaatcggacaatctcacgaataaagatctctgccagccgttgcgaagaatacgaggtacatactggaatgaagtgtgccgacttggtcagccgatccacaatcacccatatagaatcaaacttcttcgctgtccgagggagaccagtcacaaaatccatcgtgatcctttcccatttccacttgggaataaccatctactgaagcaacccaccaggtctctgatgctcggacttcacctgctgacaattgagacaccgagccacataacccataatatcctttttcattcttctctaccaatagagctgcctcaaatcctgatacatcttcgcgacacccggatgaatagggtatcgcgagttgtgagcctctgccaatatcatctctcgaatcccatctacattgggtacacaaatacggccctgcatccccagaacaccatcactatcaatagtcacatccttggcatcgccgcgctggacccgatctctaagaacaagcaaatgccggtcattatactgatgctctggaatacggtcatacaaagaatactgagaaaccacgctagccaacacccggctaggctccgaaatatccaaccgaaccatccgattagctaaagcctaaacatcaacggcaaggggtctctccccaactagaatgaacgccaaactgcccatgctaaccgccttccgacgcaaggcatcggccaccacattggccttccccgggtgatacaaaatggtaatatcataatccttgagcaactcaagccacctccgctgtctcaaattcagatctttctgcttaaacaagtgctgaaggctgctatgatccgtatacacctcacaagatacaccacagagatagtgcctccaaatcttcaaagcgtgcacaatagctgccaactctaagtcatgaacagggtagttcttctcatgtggcttcaactgccgagaagcatatgcaatcactctaccctcctgcataagaacacatccgataccaatcctcgatgcatcacaatataccgtataagaacctgaagctgctggcaatactaacactggacccgtagtcaatgctgacttgagcttttgaaagctctcttcacactcatcagaccaaacaaatggagcattcttctgcgtcaatttagtcaatggcggcgcaatagatgagaaaccctcaatgaacctgcgataatatcctgccaaaccaaggaaactccgaatctctgtggtcgaagacggtctaggacaactctacaccgcgtccatcttctttggatctaccaaaataccatcactggacactacatgtcccaaaaatgccacggaactgagccagaactcgcacttggagaacttagcataaagcttctcctctctcagcctctgcaatacaactctcaaatgttgtgcgtgctcctcctggctacgcgagtacaccaggatgtcatcaataaacacaatcacaaatgaatccaaatacggccgaaacacactattcatcaagtgcatgaatgctgctggggcattagtcaacccaaatgacataaccagaaactcgtaatgcccatatctcgtcctgaaagttgtctttataatatcagaatcccgaatcttcagctgatgatagcctgaacgaagatcaatcttggagaaaaccttagctccctaaagctggtcaaacaaatcctcaatacggggcaagggatacttgttcttcacagtcactttattcaactgcctatagtcaatgcacattctcattgtgccatccttcttcttcacaaatagcaccggtgcaccccatggtgacacactaggacaaataaaccccttttctaggagttcctgaagctgatctttcaattccttaagctctgcaggtgccatgcgatatggtggagtagaaatgggttgcgtgcccggcaccaaatcaatcccgaaattaatgtccctgtccggcggcatgcccggcaggtctgctggaaacacatcagggaagtccctcacaacgggaactaaatcaaggctaggagtctcagctcctacatatctaacaaaagccaagtaagataaacaacctttcccagccatccgctgggcctttaagaaagaaatcaccctgctaggtacataatcggacacacctcgccacacaactctaggaacaccaggaatagccaaagtaactgtcttagcatgacagtccaaaagagcatgatatggggacaaccagtccatacccagaatcacatcaaaatccgccatactcaataacaacaagtcaacacgggtctccagacccccaaacgtaaccaaacaggatcgatacacgtgatccaccacaatagtatcacccaccggggtagatacatgcacaggagaggaaagaatatcacgaaacatacccaaatgatgagcaaaatagcaagacacataagaataggtagaccctggatcaatcgcatccctgtgacagactggaataatacatgtgataacaccatcagatgcgacggcgtctgctctatctggtatagcatagaatctggcctaaccatcgccagtacagcctctagctgcctgaccacctcccctagctggttgagggggagcagaagaaactgctgcagaagatgagggctggtccctctactgagaataagatctaccaccacggagccgaggacagaacttccttatgtggccaaactcaccatactaataacaaatgcctggagctagagaaggggactgaagggagcccctcgatacagatgaaccctgggccgaaagagctggaagggcactgagagaagactggccctgctgatggccctgaaaacctcggcctgaagaggccccactagactctgagcgacttgaatgaggaggtctgaaagggctacctctgcctcgctggaactggcccctagacggagcaccactgaaacgtcctgaacctataggcctcttggcctccctctcctcacgcttacggcgacgatctgactcaataagacgggtagcatcaaccgcctcctcaaatgaagctgctgccactctttctctggtcatcaaaatacgaatagagtaattgaggccatcaacagacctcctgatcctttcccgatcattcgggatcatccatgtagcatgatgcgccaactctgtgaacctcaactcatactgagtcactgacatctcaccctgggtcaaccactcaaactcccgacgcagctcctccctgcgagactgcggtatatacttccccagaaacatagtggagaactgctgccaagtaaggggcccggccccaacaggcctacgtctctcaaactcctcccaccaagtaaatgtaggtcctgtgaaccgataagtagtaaaagccacaccactggtctccaatatccctgcagtacgaagcatacgctgacacttgtccaaaaatccctgggcatcctcgctctcaataccactgaatgatgggggttgcatcctaccaaatctctctaaacgacgctgctcgtcgtcaggcatagcgggaacaacataacccggagctggtgcaactggcaccgctgggacaaccggtgcagctggagcaactggggcaactggttccactggagcaactagagcagctggggcagcctctggggtctgcaagccctgaacaacctgctctggagtgtgagcagtaggggtctgatgaccaccccctgtctgagaagtagccgctgcagtagaagctgatacaacctgagctaacccggtgcagactgataatatctgagccaacgtctcctggagaccaggtatcacaagaggcactgccggtgcctgagtaggtgctgctgggacatccaccgctggaagctggtcctgagtctaaacagctggtgggtttgcctgtgctgcctctgctggtccaactcgaccatgaccacgaccgcgcccacggcctctagcaggtgccactgggggtcgtccggtacctctagtagcacgagttctcaccatatgcgagagagtagcataagaagatttagtttccagatcaacaaaccgcacgataagaatttcaagaaagagaagtgtttcctaaaagttctgcagcctctcgagggtctgatgcggacgtatacgcaccgatcttcgagactctactaaaccgactcataactcgtgaggcctagtaacctaggctctgataccaagttgtcactgcccaaaccccggtcgcgatggcgcctggccgcaaggctgggcaagcccgaccacaacaactcaacaccggtattacaacccaacaatgaaacagtaacaagaagtttaacagcaattttataaaataaactacccagtcagggccaaacagtatgaaagagatagaaaattccacaaaagatccctaaagaccaagggtcacgagcactgagcctctaccagaagagatacacaagtctagaagtgaaatacaatgtttgaactgaaatgaaatacatgtccgaaagtactagaaagagtgataaggatcggagaaaagggtcttgcggacgctggcagctacctctagtctccgtcaagtctgaatccgacagcaacagtagtactaaacctcagcagctcctgaatctgcacataaggtgcagggagtatggggtgagtctaccaactcagtgagggataaatgtatataaaaacccgaaagctggaaaccgcagtaaagcacaatgtaaagctatctacacagtctcagacagaacagttccaaatatatccagataagcaacagagaatataagtataaatgctatgcaatgcaatgcacatgtccgctgcggtacgtgcagcccgatccatttgggtacccgcgctcactgtgggggttcagactccggaggggctcctacagcccaagtgccatatcataataataccgctgcggtacgtgtagcccgatccatatcagtccaagatatgcatgacagtcactaaaccggttctattagagatttttaattccatttataatgaaaaccatgttcaagtcatataaccttaaaaatcgtgatctatgcaatttaaaacacagtgactagattcgggactgattcaaataataagcaaatcttgctagtacggtcatatcaatccctgaaggattcctcaagtcggcacatggtcccaaacgtagcttcaagcctaggtatcatcaatatagaaagcgaagcgatcgctaacacggtgcaatttatccctcggattaggaccgagtcacatttcacaacacatacgactccgctctaccctggagtgcgtgtctagctcacaatagcgtcacaatgtgataaatcggggtttcgaaccctcatgtaatcatctacacccattactcacctcaagccggccggaaactagcccgaaatgacttttcccttcaaattcacctctctgagcgacgaatctggccaaaaccacaacgaatacattacataatgctaatggaacataacccaatcgaaagaactcgaaaaataactcaaatcgcgaaattagcaaaacccgagccccgggcccacgcctcgaaatccagaaaactttataccaaaacgaccctcgtcttgccacgagttcatacatataaatttcatcaaaatcggggtccatatgacccctcaattcctcaataaaaatctagttgggtttcaagccctaacctccatttttagcttcaaagaccttgatttctaggtgtttaattcatgatttagcaccataatcacatattagaagtctactagttcatacctgaagaatccccttgataatctctccaaaatcgcccaaatatcgccaaatccgaagctctcttgttccccttttcttttaatgtttaaaccctctgaaattttaaaacctgctcgacttccgcttaagcggaccttttccgcttcagcggtcgtcgcttaagcaaccaattttccgcttctgcagtttcttccatttcctcagcggccgcttctgcggtcgcttgaccgcttatgcggtcccgcttacgcgacctccaaatccgcttacgcggttcctgagcttcccttgaccgcttctgcggtcgactatccgcttaggcggtcaccgcttaggcggctcttctctgcttaggcggaaataccagaagcagactcccttattcatccttaattccaaaaatcctccgattaaccatccgctatcaccccgaggcccccgggacctcaaccaaaaacataaactcacactaatacttcattcaaacttgttcgggcaataaaaacactagcttaaacatcaataatcatcaaaattaccaaatcaaagcctaagacatcatgaacttctcaaattcctattcgatgacgaaactatccaaacgaagcccgaaaaatctgaaaatttgcaaacatactcaaaatcacctaacgaaaccaatgccactctcgaaattccattccggccctcggatcaatttctcacctatcaaccggattccttcaaaaatccctcttcgccaaactaagctaactttcacaccgaacctccgaattcacttccgttttctctcctaagtcacaattcacccccgaaactagtcgaaccctcggaaatcggttccgagctctccaactcataagtcaacgtcgagttgacctttccaactcaagcttctcttaaagagactctttaactcattcttatccaattccaacccaaaccatttcaaactcaccgaatacgcataataacacacggggaaacatatgacggggataacagggctgaaatataaaaaatgacaggtcgggtcattacacattctttcccaagaatgcaatttttcagaatcatcatctattcacaattgctagccgtacacaacatccccagcagccacaatgacaccatcagctatcatcccccagctaagagatttcattgctatccgccttttaattcttgcattgcataaggctacttatctgccttccgagactaagcactgtctccatctgcatttctgcataaggctactcttttgccttccgagactaagcactatctccatctgcattttctgcataaggctacttatctgcctttcgagactaagcactgtctccgtctgcatttctgcataaggctacttttctgcctttcgagactaagcactgtctcaatctgcatttctgcataaggctacttttctgcctttcgagactaagcactgtctccatctgcattttctgcataaggctacttatttgcctttcgagactaagcaatgtctctatccgcattttttgcataaggctacttatctgcctttcgagactaagcactgtctccatccgcattttcttcataaggctacttatctgtctttcgagactaagcactgtctccatccgcattttctgcataaggctacttatctgcctttcgagactaagcactgtctccatctgcattttctgcataaggctacttatctgcctttcaagactaagcactgtctccatctgcatttctgcataaggctacttatctgcctttcgagactaagcattgtctccatctgcattttctgcataaggcttcttatctgcctttcgagactaagctctgtctccattcacatttgcataaggctacctttcggccttccgatactaagctccatctttatcctacatggatgaaatatcgccactttatttttctcacggctgcaatattgctgctcgcattaaatttttcgcatcggctgaaatatcgccaacttctgcatttcatgggctgaaaaatcgccaacatattcaaaggcatcatagttcggaggcatcatccgcatagcccaagaacatcatctcatagccgaatctttcgttatgcactccatagcccaggacgtcatcgtaacagtccgaagaaagcattcatagtccaatgggaacttgcatcacgattaaatttatgcacaatatatgcttgtattatacacttgcaggcacgccggctagcaacaaccatctcagcaggagcgaccccgctccggttcccgcagcctattagatttcaactgcaacctaaacattgcattcgttccttccgataaatctattggcatattccgccgatggatctcgaactacatatggccttattcctgtaagaccggggatatttaggcagctcaaaaatcacagctcggtcaaaaacatttgcaagtcatttctcttggtcaaaattggtcatcatatctttacccgacaactctttcatccttcctgggtaaagaggggcaacttttgatacccaattttttcctatgtattttatatactcaaaatatgctcaaaataacatgtatatgcatatataagcagacccaagcattttagtatttttcccaaatttttaaagattttcaaaaccaatttactatttattttcgcaatacaaaccccaataattgttccccaaattatcatctttggtgaataacttattttattcttgtagtcgcaccaaaatataattaaggtgatttttgcatattttatgtaaactttttgatattcctaagctaaaattgcataaattgcaattatagcctatattgcggtcttaaaattacaaaattgctcccagtatatttagattaacacttatatattattaattaattcagttcttttaatttattttaactattttaattaaatcaaaaaatggaaaattagctatttaacttatagcccatttacatttcaatcatagccacattacagctccaatttgaacccaatttcaaccggcccattttcaaaactaacccaacccaccaccctttaaagatgacccgcctggattccttacctacccattcaatccaggccgttgatcattttgatcaacggccaccttttacccttccataattaaacccaaacgaccccctaacctaagtcatttcccaccaacccgccgccctaaaatacctctcctctctgattctctctgaaacctaaacctaaccctagtcgcctccctccaattaccacctaaaatcgcttgaatccatggctttcaaagccattaaaggcttgtacttgcctactatggctcccgcatgcctgttgttcgaaggatcgagaccagacctcgagagtcttcactcagaccttcacctattcgaggattctggccatcttctgccttgctccggtggctcttggtcttttgagcctgattatgacattatctgacttagatcggatattctcgaagcctttctcgtctctagggttcatctgaaaccctaactatcgaggttcttcctgattatttttagatctgttacatgtttgcactgttgcttaagtttcttaaatgatttatccgattttatctcaaaagtcacttcttttcgattagggtttttggaaagttcttaaaatatttttgactcttctccttctccttttcttggtgtgaatcgatcactgttatgttcttattttctctttctaactcgcatgttttcttcgtgtgttcttatatttgttgtattatgaagttttctgttgtgctccgttctgtcttctactggtttcaatatcatgctctcatatgcctattttatgtgtttctttactctgtttcctactgagtttattcctttgtttgcctttaccagattttgcctggattctttctagatgtgtttcattgattgtttctttgagtttacactacctgaactcattaaaactctatgcttttcttgaaacttgtttcctgtactagtttctatgttctattcgtcttgaacttgctattgtgcttgtatgcttcacatgagactccgaaagaggtctctaagtctgtttcaataacttgccttctcgtctctgtatcaaattcgagtttttttttaaataaaaaaaccctaggttttgggggtttctttggcaaatatagtttcatgtttggacaagggttctactttgaaactttgaaccctcagtctcattccgagtttatgaattgaatttaaactttttctgcgtttgtgactttgaagcttttcttgctagtctttcgtaattagcatgacctcttcttgcttgacatgtctatgtatttcatatatgagaacttctctttcaaaggtttcgctaactgttaaactgattttgaatccctttcgaacaagattttcgatttggttcttttactggccgttttagtgattctcattccttgttttcacaaatcaagtaccaccggactttttaccttaaatttcttctatgtatttgcccttatttgtctgctatgcacaacatatttacttgttctccttccttaaataacttctgcccattaccgttcaaatttgaactccttaattaaaggaagtctatatactgattgattttaattggtgcatagttccataattacctctaaactctgattcttgccttatttgctatacctgttttcaattataaataccctgctctttcattaacacagacacgattcttaagaatatagaaatcacaattctcttctaaaaacctacacttttgcttcttgattgcactttggcttccataagtctactgtttctccatacttgcttctttgaactggtatgtcctacatttgattctagcatcaaatccaatgtgtttatttataagcttttacgcccatgcctactttactgccttatagaattcaattttaaagtaactacttgtgtattgctatatgttgctgcaatgaatcattatccccatccctttaatgtgcttgggctatagtttaagacatggcaacatacaaaattgttgtcatggattaagactggaccctttgggtcctaagctttttcaatttcccatccccattccctttctatgtactgagttaaggccttggcctgacagtatcctaattactgcccgggccatcgcttgaccttcaataggtcctgactctccaatgtttggctagcaggctggttaggggtgtgccagcagtccagttgctgggcatgaccaccagcctgcccgggctccccctaattccttttcattgcacttacacttactccaagtctctaagttctgcccccttcttatgagccttgctttgggaaccttgagttccatctgaacttggacatttgagggttggcccttccacactgcaccataatctgttctgcaatgttatttggggtgtaagcactgcctagaactcttgaagtttcttggaactctgacacatcccaaataagagaaaggctttggaaactgatcccggaatctcatattgatagatcttgagtatgaattaggttccttggatgcagcttaaatttctgatgtatttttcgatttgattcatttggtctgtaataatttataataacttatggggtttagtaaagaacggggagggttacttactgtatgcataagggtagatatcatgttcattaggtatttacttctacaaatcatgtcaagttctacatttctgcatctagaaatcctgttttaggttttgcattttcatatagaaatcttgctttaagttctgcatttctgcattcttcatatagaaatcctgttttaggttctgcacttccacattttttatatgaaatcctattttgaggttctgcacttttgcatcttagaaatcctgcctataagttctgcatttcatacatagatcaatagttctctgtatttctgcatctcacatagaaaacatgcctataggattctgcattttgcctatcatatagaaagcatgtctatagggtttctgaatactgtatacgtatctatcattaggcaaacattttttggcttaaacaataatcaattacattctagatagcatgctcgtaggatttctgcattcttgctacgcctgtaaaaagtgtttaaaattcacaacgctagaaagcatgcctgtaggagttatcaatcaattctgaatcgcctcactcgtttaagtttaatttgtcagtaataacgtgttatcaactgcaaaacttgtattattctattaaaacgggcaacctttctgtaactagtttactcctttttctgaaaccagtagatatcatgcctataggtttcacctaggcaagccttagggtaaaagctgtaactgtatcagtcttcaataattgcagccaggcggacctaatgcgaacttcttgtatgaaaatatgtgatgaaccagtccgcttaacgtttaagtttaattcagatctaatcagtatatgtaaggcatgctaaactacatatttttttctgtgattctgaggaggcttatttgagcctttacgtctaatgtgcatcccataactgtcctatatgttttatttgacgccttagaattttaacctttctaaactcttgaaaaagctcaaaaattccttcccttgataggactagaagtctcaaatgcctccgggactgataagattgggacgggtactagcatgcaataagtaatgatactattccgcgatttaataccttaatggggtgggaagggtagaatatgcatatgatgaccggtgtgctaatatcacgtgcgacccctcttctgaagagtgttttatgggtattgcattgatgtgatccatattaatcataaacctaggacccattttccattgtttatctttgtttgctttctttagaactatttaaaacctttcaaatttctactctctttctacttacttttcacaagttttcaatttgttgtaatatgatctgtaaacccttatatgagccttaattgtttatatgtttatataaagtcacattgtaacatggtcgggaccacactaccggatcttgaggggtgcctaatacctttccctcgagataatttctagctcttaccctaatctttggttccttcatctcaaacccttcttaaaagtgcctaatgcactataatcattaggtggcgaatcttcaactccaaaaacccaattctcgaaagggaatagagttgtcctcccaaatgtcgtatacccgatttcgccttggaaaaagcgggcatcgacatctagcatgactgttagtccttttattgtgtttattctggttttattgtgactcttccatgcataattgatgatttctatgtaatgaaagagtatgagaaagaaattatgaattataaactctttggagcgttggctcgaatgataaagtaaattattgagcaaggaatgaaagaaagagaaagatatgtaattattctcttgcagggctgttatcgtatattgattatctcccttgccgagatgtgaaagttgttgttgatgttccctttccgggatttaactatttacttgtgttttcccttgccgggatttctactatagtttgtctatcccctcgcccctttggttgtgattgtttcttgggtgaggaagagtgataaaacacgaagtttgatgtcgtacacgatatgttttgagaatatactaatgcacgaaggaacattccgtgccatgattcgattactaatgcacgaaatatcattctgtgccatgatatgattactaatgcacgaaggatcattctgtgccatgatatgagtgttaatgcacgaagggtcattccgtgccattattatgtgaggtaaaacatgaaggttgatgccgtgcactttatttgattcttttggtgagaacgagagtaaaagcacgaaggatggtcttgtgcagtttttgatttcctgctctcgttgatattgtaattgtatattttcattccccatttattgattttatatctggactgttacagcccctacagcatgcccctccctcttgactggttaatttctgtattcctttctattgcatatatatattgaactacacaggtttgtttggtagtctggtctagcctcgtcactacttcgccggggttaggccaggcacttaccagcacatggggtcggttgtgctgatagtacactctgtgcatctttttgcacagatcacggagccggagcagctttcggacagcagtaggagatttgggagctgacttcagtccagagacaccgaggtagccttgctgatgtccgcaggcccggagtcacttctatccttattttcgtttgttatccttgtaccgaaataaaaagtattgtgttctattcagacattgtatttagcattctctagacgtcgtgagtttgtgactccagttcttgggtagagttgtattggatttccgcattgctttcgttttatttatatttaagaccttcgcttttctattaaatgtttcgttgctttaataatatcggtgtttgttaaaagaggtagtaaataattggcttgcctagctcctaatagtaggcgccatcacgactcctgagggtgggaaatccggatcgtgacacttacttgtaaataataagggacttctgtaataattaatatttatacactagtccctatgagactagtatataaagggggttattcatttgtaagttgaccaagcaaaacaatcaagttctctctaatataaatgctttctttagcaattctcatgtgttctattattctcttagagatcttcagtgtatagtaaggttgacttgacatagcaagaatgtgagcaagttatgtaaaatcgtgaatgggttaacaagtggaagtggcgtacgtgtacttaattaacgattaaggacgtgacactagcctctattcactttccactagttacattttaagtttgtattttgttttgttttgtctttgctgttgtaacttgcaataaagtctagatcgacgtcttgtcttgtagtctattcatatattgttgtactgtaggtactaatttgtttaataagctcaatttaagtaatattaaagtgtccaataagagcaagcctcttagtttaaatgtcaaaagttggtatcaaatttaggaagctatttatgctctcgtttggtcataaattttgactattatttttcaattaaaattcttttaagttcttaaaattttgatttatgacaatttttgatgaattttctttcaatcataaaattgtaactttctttcaaataaaatgtaaacacaacttcaaaaattattttttcaagtttaatttaaatatatgttcaactatgtaatcatttccgcttatgttttatcatgcattttcataagttaatttcatactaatctacatgcaaacacttacacataaaagatattttattcctaaatacaacatgtgatacgagatcattacagtgtaagtgtaccttattattggtaatttttggacttcaccaaatataattaaggaagtaatgatatgcaataaatatgttgcctttcatcgatggaagttagcgttattctgatattgggtgaaaatagcataagctagctagtttttgaactgataatagaaaaatagtcagcgtttgcaaagtcattaaaaatagtggcgaagccagaaatttactcaagggtgttcaaacgtgaaagaagtgaaaaaaattcttcaataaagagtgttcaatatacattatatgcctctaaaatttaatactttacctataaatgcagtataattttccgacgaagggtggtcagttgaccacccttcaaaacatgtagcttcgcccctgattgaaaatagctactattttgcttcaacacgaaaagttccagcataacatatatactggagattggtgtatctgtgcatgaacttccagcatattatgctgaactccaatacacggaaagttctagtataatatactgaagatttgagcacatgtgtatgaacttccagcatattatgttggaccagtatattatgctggaatattttctggaaattcagtatattatattggaactacggtatattatgctggaatgctagtatattatgctggaatatttttcggattttgaacagtattttcattcagatttattacataaaagtggctaaattttgattatttttgaaattatggctatttttgaattacgaaaaagacctaaaaatgccactcaactttcagaaatggtctatccatgccatccgttaaaaaattgctcatttcatgccactgccgttacacatttagcccattcatgccattattgactaacgacagtggcatggatgtgccaaataaaaattgagtcgttagtcaataattgcatggatgggccaaatgtgtaacgacaatggcatgaaatgagtatttttttaacggatggcatggatagaccatttctgaaagttgaatgacatttttaggccttttccctttcaattataacttgtaaatctggtcattttttaattttagcccatattggtggaattacgattatttgtctccttatatggtcatagactctcggaataattcatatttcaagactagctattttttagagctgaattaagtttaaaattcatttcttcatccgagggtgcgagatgttaaacagggactgaggaaaagaattagccgcagactattcggacgaactcaccagcttttgcataaattttgtatttgtattagaaaatacataaaatatgtataaataatatctaagacaaattatgagttcatgataaattgaatttataaacttcaaatcctaactccgcctttgattttaaggtgtcccatatttgtgtaaaaatagcacggtatagccaattttcgcactggtcaatcacaaatagccagcatttaccaaatcaatgaaaaatagccactgttttgctgcaacagagaccggtcccgtataatatatgggagttcggtgcatttgtatataaactccagcatattatgcggaccggtatactttgctgactcccgtataatatacgggagagtggagcactagtgctccaaactccagtatattatgctggaccggtatacttgctggaactccagtatattatgcgcgagttccagcataattatacttgaactcccgcatattatacgggagttccagcatagttatcctggaactcccgtataatatgcgggagttcaagcatacttatgctggaactcccgtataatatgcgggcgtatttttcggattttgaacagtattttcgctcaaatttatttttacataaaaagtgattagatttcgattacttttaaaattagactatttttaaatgaccagttgtaaaactagctattttcaaatttctccccatatttgttgagggatggattgttatatggtcttgggcaacagttggagtcactcggccaccaattatctaaatttggcccattgtttcccattaaaacaatgggattttttcctatctataccatataccaaaccttattaccaaaaatgttcatggtttactatttacccgacctgttcatattatgactacaatttatataccaaatccaactcagcgagattctttccaacaatagcgcgcgtaattgtagggagagaatcttcatgatctccaatcagcatttaattagaattctgaaacggaaataattttgtagatgcgtaaatctctccttctccaactggacgagatctctcttccctacaattctgaaaataagtaaaatccagaatctccatccatcgaattgaaaaaattcaaaatttttgaacacagatcttcgtcgacttcttcatcttcgattctatatctgttcttctatttttttgtcctctcaaactacacgaaatcatgacgaaggtcacaataatgctgaaatcgaatggaaattgggataaatatggaagatttagggattttgaagttgatgccattgtggtagatgacgatgcaagctacgcaattctcatatctacaattgcaaaacaattgtctagagatttcaatatgcaattggcaatcaccaatgaaagcaccagtacaggtatgtttcagtcgacattgaagagtgttatggtgttcttatttaactacaatttaactacaattaactacacttcaactacaattttcatgtagtgctggaaactgtatatgtttcagtcgacattgaagagtgttatggtgttcttatttaactacaatttaactacaattaactacacttcaactacaattttcatatagttctggaaactgtatatgtttcagtcgacattgcagagtgttatggtgttcttatttaactacaatttaactacaattaactacacttcaactacaattttcgtatagtgctggacactgtaattttgatgttgcttttttatttacctacatagttactacatttgtgattttattttctgcaggttctactggatcactaaggctactagaaattccatcctcaccagctatagaggaatatcctcatgcaatgaagaattattcagtgcagcacaagttccagttcatttaactacatgacaataacataaactacatttaactacatttaactataatagaactaccttttactacaatagaactacatttaactacaaatcaactacaacaaaaactacatttataaactgtctaagaggcatggctccaattaaactacataattgagataaataagttgcaaaattaggaccaggccacttttaacaaaaatacacttgaacgatcaaagaagaacaatgtaatggctaaatggaacagttacataatgtaaccttcaaaaatgtagtgtaattgaatttaaaatggagttaaatgtagtagttacacaggttgcaataaaaaaccctataactacattttattaagtataactataaatcaattacaatacaactacaattatagctgctatgtactcacagtgccaaataaaactacaaaattacaataaaatcgtgggggaagtgaatgaacgtgatggaagatcacgaaaatgaaagaaaaaaaaagtgaagaagaaacgtgggtgggggggaattaacagtgggtaaatcgtgggtgggggagggaattaactgtggggatgagagagaagcgggtaaagtgaatatttggaaagattctaaccctaaatacacgcctacattaaatgaggagataattaatgccctaatttgaattatggtacataaagtgaaatatggtatgcttaaatgtaataaatgtgaaccttaaacatgggtggtaataaggtttggtatatggtatacataggtaaaaatccctaaaacaattcgccccaagttgatctatttgtcaagtggccatgtgacaactcaaatttttttatttttttatttttttttggaaaattcctaggaaattcgctgctgctattcttcgggtacgcacggagttacttgctcactgtgtgttagctcgcaaatcacacaagagatataaatcgcattaggcacgtccggtgcggcaagctttgactgagaagactgctggtgaggagaatcaatctcagatctcctatatgaaaaatcactcacccaaccaatcccgacgggcgtgacttcaaagtaagccttttgtgaaggctttctttttgtcatttttctcccttgttcagaacaagttgttcagaacgttgcacgagacattattaagttttctacaaatagggaagaacattgttttccttttttacagcaaaaacttgaaactccaaatagctcatcaaaatgttttccaaaactaacctttttctttgcctttctttggctattttgctaatagtaatatcctcacaagctgatgcaagggagatgtctaaggcgcctgctacaattacccaaggtttatttacttcttcaatctattactagtagttattttcacttttattattttgtgtcagtaaatggattgtaacattatcttatggtcttaaatatatcatataaaaataaaagtttgtgggatgggtgtggggggaggggggaggggggaattactaaatgtttttaaaaggaaagtaaaacccataggctaaaacagagagagtaaatatttacataatcatttaacattttgctgaaagtttaatggacattttgagactttcagagacattctacatctaaaatatttagtaatcttatgatatcgcaacaataccgcagaatttggtgatatttagtaatcttattattgaatttggtgattacctcttataatagtttaaactctattgctagagcaaggacacttcagtttaattatttatacgtttgcaacgtgcattcttacatgtggccatgattctttttttctggccatacacgtgaaaatatctttacttttggatggcgataagacttgaatatccgaaaccttgtttctgccgattgtgtgatcaataacaataacaacaaagttagtgtaattccataagtgggattttagaagaataatgtttatgtaaattttaccttagtcttgagaagatagagaaactatttctgataaataattcggcacaaggaaggatgaaaaagcagtgaaactaagtagtaataccatcaagatatcaagataactgaagggaaagaaccagaggcggagccaggatttgaagtttatgggttcggagttctagtccttttaagttactgggttctaaattaataatttatacatattcaatggatttttcaagataaatacatggattggaccaaaccgactgggttcggccgaacccgcagtcaatgaactagctccgcccctggaaagaaccagcaggtagtgataaaaatctgaaataagaaaacacaagactaacactgatatatattactgtaaggaaaagggagatgcatgactacctattaaccttctactctatttttcgaccaccacgcctacttatcaaggatttatgtcttcggtaagctgaagcagcaccatgtcccgccattgtgtgatcattctatttaaaacttaagttattagaggagcaacgcacgttcatcctagtttatttatgtctgcagcgctgagaattaatactaccacatttaaatttcctccattattggttaacctataactaatacattactctgcataacctaatttggtgcagcaatgaagatgggtgcaggaatcaacggcgtcggcaaaggcgtcggcaaagctgttggcaaagtcgccggcaaagcttgtaaaatttgctcatgtaaatacaagatttgcagcaaatgtcctaaatgtcaagactaaagttaggcctcagagactatatacctgtgctggtgtgagtttagttttgagaataaagggaaagctatgaatagcgtaatataattctattcactttgttttgttagtagttcttattgttgcaacttgcaacaagtccttgggtcaaaatgtacctcttgtcttgtagtctttttaactgtatagtattgtactatactgtattttgtctttagctacttgatatttgaaaccaaattcgattaaatttaattcgggttgcataaattctactacaatcagacatctctataacagtacccctatataatagtttttcattataaaaggcaagttttttggaaccgatttttatgttatattataaaatatattttctttaacaatactttactatagcagtcaaaaaatatcgaaacaaacaaggctgttatggaaatgtttgactatacaaggaaacggttcctataaaaaggtttatcatttttagagttcgaacctaagatctgaaagactgtgaatattgtgaaattttctgtgtattattacttgtagtaacatgtgtatttatacaagtatttgtgtaaaagaagaaaaggaaaaaataataaaatcagaaaaactacctatacagctgtccactccttatttgctattagaaaaccaactaacagaataatattcttctatatctatttacacggttcacatgtgtgggattttagtgtggaatccaaagttatgcagctgtagatttcttcatctgatggtccttatttaatccatcaccaatctgatcaagggacaagattaagccagctgtcaatgttgaatctgaattagactttgttctagatatgtccgaaacatagtctaatgttgcaaaacctaaagtgttctgtctcttatcttcttcttccttgtgagagtaaatagccgccattgacatcttcttctcctccatcgataccttcttctcaacatcccccctcaagttggagggtaaggaaataacacccaacttgccaagaatagctttttgcgaaggccctgaaaggggtttggtgaacagatgtgccagctgagaagatgaagggacataggagagggagattaaaccagagaggaattgctgccggacaaagtggcagtccaattccacatgttttgtacgttcgtggaagacggggttccgggctatgtgaatcgctgctttactatcggagaagacaggcaccggcagagatggagtagcagagatatcggaaagaagacgagtgagccaagtgagttctgctatgactcggcgcatggaacgatattccgcttcagcggatgacaaagaaactgagacttgtttcttagatttccaagagatgggggagccaccaagactgatataaaagccactcactgaccggcgactgtcagggcatgaagcccagtcggaatcacagaaggccagaagagaaagagatggatctgaattcaagagaataccttggcccggattcaaactcagataacggagaactcgaagagcagcagagaaatgtgagcatcttggctgatgcatttattgactcaattttaacacagcaaaggacaaatcgggtcttgtatgggttaaatagtttaatttccctacaagatgccgatagattgttggatcaagaagcaaaggaccttcatcagcacggagcttagaagaaggttcgagtggagaggagacagaaggaagcccagaaacatcaaactcctttagtaaatccaaggtatatttcctttgacaattatcccctgtttttcgcgaagtatttccatgcccaagaaataatgaagatcacctaaatctttgactttgaattctttgtgaagaaaagctttgagtgaggtcatttctgccaaatcatctccactgataagaatgtcgtcaacataaacagccactatagaaatctgattgtttgtcttcttgaaaaataaggaataatcgtttaaagatgaagaatatcccttaaaacttaatgcaccagcaagccgagcataccattgccgggaagcttgcttcaaaccataaagtgactttcgaagtaaacaaacatgattgggactgggggagggtatacctgctggaaatttcataaagacctcttcttgtaaatcaccatgtaaaaaagcattgctcacatccaattgagaaataggccaattcttcttgacagcaatggccattaagcagcgtattgtagtcatcttggctacaggagaaaaggtctctgtgtagtcaataccctccctttgaatatcccccctcactaccaagcgtgctttgagtctttcaacaatcccatctgagttatgcttgaccttgtagacccatttacagggtaaggctttcttcccttatggtaaaagaaccacatcccatgtgtgattagcctccaaggcttcaacctctgattgcattgcctgcatccatcctggatgggcagaagcttgagaaaagctgcttggttctgaaatctctgaaagtgagtgcattatctgtttgttatgagcagagagtgcaccaaagctaaaaatattaggctgacagggttgaatgaaacaagaggatgtgagatcagtgagatagacattagagcaaacaaaatcctgtaggtgagagggccatttagtaactcgagtagatttcctgataactggtggaggagtgggtgttataggcaaaacagtatttgtgggagaagaagaattagaaggatgaggagaggggaaggaagagggttgaggtgagtgaaggctggtgggactaggtgataaaggtagaggaggttcagaagagtgaggagatgggaaggaagagggtggggaaagatcactgatggttgtgacaacaggagaaggggtagggaaaatctgatctggaatggaaatatcagatttaggtgaggaagttgaagcaaaaggatagatgttttcatgaaaatgaacatctctagacacaaaaattcttttagtatctaagtccaatactttataccccttttgacctaaaggatatcccagaaagacacaacgttttgccctaggttcaaatttgtttctaccactaggcaaggtagaaacataacaaagacatccaaaagaccttaatgaatcataggaaggggatttatggaatagaatagagtaaggtgtgttgccttgaagaaccttggaaggcagcctgtttattaggtgtgttgcagttagtaaacactccccccaatagctgataggtacctgtgattgaaaaagtaaggcccttgctatttccaacaagtgtctatgttttctctcaacgatgccattctgttgaggtgttgagacacaagaagtctggtgtaggatcccttgagaactgagaaaggctgcttgttgtgaccccttgcctaattcaaatgcattatctgttctcaatatctgtaccttgacagcaaattgtctctcaatcattgtcaaaaaattctttaagactgtgaaagcattactcttagtgcttaacaagaatgtccaagtccccctgctaaaatcatccacaatggttaaaaaatacttaaaaccattataggtaggttctttataagggccccatgtatccacgtgaattaattcaaatgctcttttggatttgatttgactcaaaggaaaaggaatcctagtttgcctagctttaggacaaatatcacataagcaatcagaatgggaaggcaatgaaataaaactaagattcttcattgatgaaaaaggcatatgccctaatctaacatgccaaaggtttacatctgtaaccacattagcataaaatggaaagataactgaaagctgattgaaaacatttgaaaaagaaggtgaaacagttttctccttaagactaggcttcaacaggtagagtccttcatgtgtatcaccaaaaacttgaggcctcttcattaaaggggcctgcaatagacattgaacaggagtgaataagactatgcattgaaactgaacagaaaatctattgactgataatagattatatttgaaactaggcacatgaaggaccttctctagaatgaaattgggagatataggtactttccctgtatgtgtaactgtgactttaaatgaattaggaagatttatgtgtaaaggtgtaggaagaggattgtcacgacccggatttcccaccatcgggagtcgtgatggcgcctactaagggagctaggcaagccaacttaacgcaatcacaataactcattaattaacaatatgaacttaaagtggaagaaataggtgcggaagaacatcatatatataacataacatggccaaattgcggaaaataagaaccaatacagacttctacccagaacttagtgtcacagtatccacagacgtactaggagttactacaaataacggctcaaagaaagaaatgtcatgaaatacttgtccgaatacaatggactaaataacaaagacagaagagaccaaggacccacggacgccagtgagctacctattagtctctggactgaaggcgcgctcccaatctactgctggtgctgctgtccaaaagctgcccccggatctgtgcacaaaagggcacagaaagtgtagtatcagcacaatccgaccccatgtgctggtaagtgcctggcctaaccccagtccacgaggtagtgacgaggctagaccggacctacagcgttaacctgtacagattatacatatatgcgaaacagggaaaagtaatacatgaattaaacaagtaagggaggggacatgctataaggggaaaacagttcaataatttaaggtataaattaactaaagcagataatccgtaaccatcaagaagtaaagccccaagtataagcatatctcgtggtaggcgtaccacccgccctcatttcatcgtatcttgtggtaggcgtaccacccgccctcattgttatcatatcttgtggtaggcgtaccacccgccctcatttcaacatatcttgtggtaggcgtaccacccgccctcatttcaacatatcatgtggtaggcgtaccacccgccctcatttcaacataccatgtggtaggcgtaccacccgccctcaaattatcctatcttttagctcaattcatttatgcaccagttctatctcagggaaacacaacaatgtacacatattatctaacccgacaagggtgcagctataaccaatcaatcccggcaagggacacaagaaaaacatataaagctcaaccttattagacatggcatttcacttcacttattcaattaagcaatttaagtcgcttgaagccaacaactcattcataaggttcaaaacaatagctagatccatagcatagctttcaactaattcaagtaaagactcacggtcatgctttgactcgggtgcataggtaaccgtcaccaaacctatacaccgacccatataacacatagcaaacaacttcctaatcctaatccctcgaactagagttagaacaaacacttacctcaatgccgaattggcaattcaaagctctaccaccgccttccctttggaatccaactcccaaacaacgatatctagtcataaattatccaaatgaattaataaatgctaattaaactagtttgaatgcataaggatgagtttcccaaagttttacccaaaatttcccaaaacgcccccgggcccacgtggtcgaaactcgaggttcggaccaaaaccaagttacccattcccccatgaatccatatctatgattggaattgaaatcggacctcaaatcggggtccaaaagctcaaattatgaaaaccctaggttctaccaattccaccatttttaaccatgaaaaagcttggattgatgaagaaatcatgttagatgatgatgatgattgaagaagttgagtaaaattagacttacaaacggattggagaagaatggttgagaggaaaatcgcctaagaggttttgggttttgaaatgttatgaaatggggttcaaaattcgtctaagtatagatataacaggtgcagatctcgcatttgcgagcaacagggttcgcatttgcgaaaccaggcaggaaaggggaaatctcgcaaatgcgagtaaagcttcgcatttgcgaagaagctggccaagagggaagtctcgcaattgcgagaagaacttcgcttttgcgaagtaaaagggaggagaggcagacgtcgcaattgcgacacagggctcgcatttgcgaagcacacgaggaccaggagggtttcgcatttgcgaaacatagatcgcatttgcgatggggaagcctggggaggggcaggtcgcttttgcgacgggtacctcgcaattgcgaagaggaaggggaaagctgagggttcgcatttgcgaacaaaacatcgcaaatgcgaagaagacaccagatatcagatttttttgcaattcacaacatcccgaaccacctccgaaacactcccgagccctcggggctcctaaccaaccacccacacttactcaaaaacaccctacgaactcgctcgagcgatcaaatcgctaaactaacatcaaaatcatagaattcaaccataatttcataaatttcaacctttaactttcaaattctcaaaaatagattctctaatccgaaacacgtcaaacgacgtccaaattacatgaaattttacagaaagcgcttaaacgccatataagacttgtaccgggcgtcggaaccaaaatacgagcccgatacgacattcaactctcgatttatcattttcaaaggcttaggccaatttcaaaagctagtttcacaaaattctcatatcttgggcttgggacctcggaattcgattccgggcatatgcacgagtcccaaatttcatgatggatctacagaaattaatccgacgcgggtccgagcccgtttacccaaaatattgaccggagtcaaccatagcaacattatacttgaacttcaccattttaaacatagagttcatttttaaatattaaaaatcttccggcttcgcgcccggactgcgcacgcaaatcgaggcaacctctcaagaggttttcgcggcctcagaagcacggggcaaggagcatttatggtgatgaccccattgggtcgtcacaaggatctaaagaaataaaagcatttgaatcaaaacacatatgttctgaagctcctgaatcaattatccaaacattagtgttgaaaacagaaaaacaacttcctgcatatttgtgaatagtaccagctactgcacttgcatttatctctgaactgttgcctccatctgaaacttttacttgtttgatcatttgaatcaattgtgagaactgatccttagagaggtgatgattcaggacttcattataactgcctgttggatcatctgattgatctcctgtgagcaccccattgcccctaatctgattttgatatcctttggcatttgtgaactcaaagtcctcaggaaatccaataatcctgtagcaatctgcaactgtgtgtcctatctttttgcaatgagtgcaagatacattagggttgaacctttgtctctttggttttgaggttgtgtttctttgtgactggtttgcaaatttctggatattgcttcctggtttctgaaactgctgcatggggtttcctcccttttgagactgttgattctgccctgtgtacctttgcatttgcttgttatttcttagtgcatagctttcttgatttcccaccatgaaggatgaagagtcagaagaaatgagaggattcatgtagacttctctctgactctcatcctgtagtactagagagtaagcatgatctatgctaggcaaaggattcaacattaaaatgtttcccctagcttgaccataaacatcattcaaacccatgagaaactgtataagtctctcgtcttccaaagatttttcaaacttttgttttcctgaacatacacaagcacaaatacatttcacatcacaaagtagagagtccagctcatcccataaacgtttgagttttgtgaaataacttgctatgtcatttgtaccttgaactagagaagatagttccttacgcaagtgatataattttgctccatttgattttccaaatctgtgctctagactgatccaaagttcccttgcagatttggagtagataacactgtctccaatgtctttggagagtgaattcaacaaccaagaagtgaccatatcattgcacctggtccatggctggtattccttggctgtgatggcaggagcagcacaagttccaccaataaaacccactttgttctttgctgaaagagcaatcaaaacagacattttccaaccttgaaaaccttttccatcaaaggctgcattcaccaagctcattcctggagcatctgatgaatgcaagaaataagggtgatttggatcgaagttagctccattactggaagcagtttgagtgagagttgtttctgttgtatcacccatagtgagtgaagctgtgatgaacagaaaattgaagaagaagaatgaagattaatccagaaacgagctatgctctgataccatgaaagactgtgaatattgtgaaattttctgtgtattattacttgtagtaacatgtgtatttatacaagtatttgtgtaaaagaagaaaaggaaaaaataataaaatcagaaaaactacctatacagctgtccactccttatttgctattagaaaaccaactaacagaataatattcttctatatctatttacacggttcacatgtgtgggattttagtgtggaatccaaagttgtgtagctgtagatttcttcatccgatggtccttatttaatccatcaccaatctgatcaagggacaagattaagccagctgtcaatgttgaatctgaattagactttgttctagatatgtccgaaacatagtctaatgttgcaaaacctaaagtgttctgtctctttgtaacgacccgaaccgtcgtttcctgtatttatgcccggtaatccccgttaaatgtttgttcatgtttcaatatgtgtatttggagaatttgagtcaattcggattgagtgtggtaagaaatgagacaattagtctctttaaagaaggattagtttggaaaagtcaacccaatattgacttatgagtttgagggctcggaacggatttccgatagctcgactagttccggaagatgatttgtgacttaggagtgaaaacggaagtgaattcggaggttcggtgtgaaagttagcctattttggcgaagttggaatttcggagaaatccggttgataggtgagattttgatccgagggtcggaatggaattccgaaagttgctgtagcttcattatgtcattttggacttgtgtgcaaattttcagttgattcggagatgtttaagtcgagtttttgatcggatatgcattttgaaagtttaagttcatttagaattgaatttaaggattttttatgattttgatgttaaagatagcgtttttatgatccgagcaagtttgaatgaagtaataaatcatgttggtgcttttggttgaggtcccgggggcctcgggtgtgtttcgggttgcgagctcgctattattcgatgtttcaatgttacatctttggacataaatgggtataatgttaagcaaatgagctccaaattcagttttgtttgaaccattagatccgtatcgaaattcagagccataggaaaaagaatcatcaaattccgagttcgtatgaggaagttatgctcgtttttgtgccggggaaaagtctgcttttgtcagaaccgcttaagcggactttgaccgcgtaagcggaaccgctgaagcggccaaaagaccgcaggagcggtcccagataggacaaaaagtccgctgaagcgaaaaattgtccgcttatgcggtccggacagtgtataaaccgaggttcagtgttttggccataacttgagttctagagctccgattgaggcgatttttggagcaaaatgaagagggtttcgatgggaattgattggaggtaagtttcttgacttagaaacatcatttatttgaagatttaacttgtaaattcatggaattaagctaaaaatggaggttagggcttgaaacccaacaagactttaaatgatgatttgaggggtcaaatggactccgattttgatgaacttgatatgcacggactcgtggcgagacgaggattccaaaactgtaaattttgtaattttttgagaagcaggcccggggctcgggttttgtctttttcgtgaatttgcatgtttttcgagatatttcgattgggttatatcccattagcatcatgtaacatattcgttgcgattttgggcagattcgacgttcgttgggaagaattcgaaaggaaaaggcgttttgggctagttcttcgaccgtatcgaggtgagtaatgggtgtatatcttatccgagggtttgaaaccccgtattatcacattgtgaagctactgtgagctggacacgcactccatggtagtgcggagtcgtatatatgttgtgaattgtggctcggttccaatccgaggagtaaattatattgtgattagcgattgattcgctcttatatggataatttttgggctgaatgccacgtttggggccatgggccgacttgaggtgtccttaagggactgaggtgattgtattagcatgacatgctcattatacattcattatgcatcatttgcattcatatggatcgggctacacgttccgtagcgggatactgatatggatcgggctacacgttccgtagcgggatactgatatggatcgggctacacgttccatagcgggatactgatatggatcgggctacacgttccgtagagggatactgatatggatcgggctacacgttccgtagcaggatattgatatggatcgggctacacgtaccgtagcgggatatggatcgggctacacgttccgtagcgggcatgtgcattgcatagtattgcattgcattgcatagcattcacttttatgcactctattgattatctgaggaatttcatcactgttctggttaaactgtgtaggtagctttatattgtgttttaccgtgctttcctgctttcgggttattatatatatttattactcactgagttggtagactcacccattactccctgcaccatgtgtgcagatgcaggtagagctgagacaacacctgagtactgattcttccagatcagacggtggctaggagtaacgaggtagctgttggcgttcgcagccccgttttctcccttatctcttgttatttgtattattccagacttgtaaagaaatattgtaaattctgtagtagctcatgacttgtgacaccccgatttcgggctgagtcgggatgggttttgttattttatcacgcttgctatgctttcatgactttttattctgttaattaattataaaaaggcgtattgttcgttgttggctggccttgtcttcacgagaggcgccatcacgaccgtgttgggattttgggtcgtgacactcttatcttcttcttccttgtgagagtaaatagccgccattgacatcttcttctcctccatcgataccttcttctcaacaagatctttgattaaattaaattgaattcctgcctccatcatttcttccaaatttatgttccaatatcttctttgaaataacctttatccgtagtatatattggaatcttgaaccaggtaatcttatgtataaacatttatataatctatatatatttaaaagccaaggatactagcaccacattaagccacttggcgtcgcagaattttgccacgtgtcccgttcagacacacatcctacaatcttggaatttcaattcaatgttaattaaacctaataaaaaataaatagcattttaaccactcaattaaaaaccaatagtctttcatcgtgtttgttttaatcccattcttaaccgttcttttatttaagattttttgtttttaaatttttttaattaaatcgttgaggggcagttacagaacaatagtcactagcctttaatattgcctttttccctaagttggggcttcaatcccacgatctctttcaactcctcgcccaagaatttttctgcgttggattccagtcgctccaaccacgatctctcaccacgatttcatatcctcacccatgattttttctgccctagattctcagtaccacgatttcagttctgtcaaatcagttttctatttttacgatttatagttctattttttctcccttgtgttcatatgaaacaacaactctggactacatcagtcgcatataagttacattaatccagcattgtgataaagttgatgaagttgatgttcctaggttcatctgttttgtcgcagcctgctaatgtcggctattttttcatctttacgcataactgttgtagcattttggttcttattgattgttcataaaacttatatttatcactgattagcagatttgggatgttgaggatgaaaacgatgagcaatttcttttggaagaagatagtcgtcgtggacctgccactactcttggctacattgttgttccaccaccacctgctcgataaattgtcccaatggtgccaccgcaacccgccaaggtcgcagctatgtctgaaaaacctgcgccgttggttacaccagcagcctctgaggaagacgaggagatcataaaattcgtggtgcggggaaaatgtcgtttgttctcatctttttcgcatcgcatctgaagacgaagacatgtaagccaggtatttcgggataacaactaacaaggctaaagatttagtgtagtaatattgaagtgactgttggattcacaaattataaaacagatacttgctatcttcctttggatatctacatgttttgtttattggaactaaccaaaaggtttttgataaggacagggttcctcgcctacgctttcacagttatgacatttgtaatatgtaatctggtggttgctatttcattgccctgatcatttgtatggaaaacaccacatggtggaaggtgaaagagattgaccctgtagaacagagaactaaaggctattgtccattgactctaagagaagttggactattcctttctgctcttggatttccatcaaatacgccgatatatattactgaatatttccatggaaagggatgtactcatatttaaattaccaatttttaacaatgttgatgagaatctccttagactcggtcaactcagtcgaatgcatggacctgttccacagaagataacacaaaaagagaacgaaaaaggaacatatgatattcccgggggctgcagctttagtcttggactgtggaccaagcagtggttattgagttgagaagttgccaaattcacagattgtctaaagttggcttcaagacaaattcttatcctggaattttactgcttagtccatgtgaagaactaacgtgaagctccaatgtgtgttaacttctgttagcgctaagtataagcaaaatacttaatcatgtaaatctcttaaagctatgttccactctcaattatttttactcttcatgttattttacattgctagaaaaacttcttttatttttcccattatataaatatgccccaaatattttctttatcatctgcttagtgaaacattatgtcgggattatctgttgtttgttactattataggttttgattgaacaatagttgtattggtatccgctggataatgtgtagttattatttttctttatcaattgcctgcaattagctattttacatcagggacatggttaaggaaacagagtgaaggaaagaatagcatattactatttgttgtcgcttataatttagattaactaaacaccttttgcaatggttgaactatatggtaggataattccctgttgaactcctgaaaaatttcagaaattcactctgttgccaagaagttaatgggtaaatctattgtcttcaatatccataatactattttcatattggttggaagaagggagtcattttaacatcaacattttcagcacatagaataggttgataacatcaaatccattagttttttgatttccttggaaattagatcacaagtatcccatctgacagaatatgacatcttctcctttgtcatcttcagcttccctcttaatatcctcttcggtttctgacttgatcgtgttgttgcatgcgaattaacatatttaagttatttctgctccactgtatccttcttttaactttactggatgtctcgagtgtacattgcgcgaaaatggccgtttcaagtgggtattcactattatatttgtgggttgaaatacccatgctgtaattgttatgactgcgaaagttgtttcacatattgtcctccctgcgattgtgtaagttgtcataacacaagttattctacttaagcagatcataatgatgtttccaccacttcaagtaaacaggtatcaggctctgcaatattgtacccatgtactagaattccagcctgctgaatgtagttgaaggaaaattttcactctgctgcaggatttagactggagtgacttgctctgcaacaaataaaacccttactaacaaaagaggcaagttatcaatttttcaagttctgtttttaagtttagcattctctttggtctacagtgatgatgatttcttactctaagtaattgtgcctacctttaggtgattgatatcattaaagccagtatagatgatttaggacctctcagtcttgattcttttagaaagaacaatttgtctgcctcatggagatttgtcgggcaagaaatcatagataagcacaatgtagctgatgtagaggtcaggattgagctatgcttttcgtaactaagattcttatctgtcctgaaaaaatcatgtgactagcaacccattaaaaaagcaaaaatcatgtgactagaaagatactgatttcttttctgtttcgatgtatcacaggtaaataagccaagtccaatagctgcagattccaaaccagaaattaccagaggcaaacagcataatcctattaagggtaaatgatttgttacagatcttggtattaattttagttgcatcatacacgtttccataatcaaggactttctaatttttcaggggataattcccagtttgtggattcacccgcgaagttggccagaagggtatgtatagttattctgttttagaatcgcatttatttttacttctcatattagcaaataaaaatttattattttgaactcatccttcactgcacacggaatagttcctcctcacaatcttgcttgcattccatctatgaataattgagttataactttccaacctgctccgcagcaactgcgagagagaaaacgtgaaaagcgtgctgctgattttgtcaaacgagatgatgatgtgactgtgaagcttgaaaatgctgccattgagcgctccaagtcagttcactcttctgtgctggggatgtacagtatatggaggaaagaaaacgataatgagaacactgattcaacagtacgcttgatgcgagatcaaatgattatggcaagggtgtacataagcattgctacaatgaaaaagaagcttgacttggcccaggagttacagactcggcttaaagaaagtcagcgtgctttaggtgatacaggctctgatgctgatctaacacgcaggtaattttttttgactttttttgcaagctcgatcacattgctttttgtctccgctctatacagtacttgaggagaagatcatcctcaattaagtttcaagtagaaagaacaagtacctcttctctttgctccgtgaaaagcagtgattctgtcttacacaaatatctgcggagcaagccacttcccctaatacacaaactcgtggtaaaaaattctataggaatatttggtacatctgctataatcaaatgcccttagaagttacagagataaccccctgctgacagttctaaaatgtgataaaaaggacttgaggacaatcttccataagtgtgggcagtcttctgggttgttcatattttacaggtggggtttgagtgcagcattttaatgaaaggaaaatggaaaataaatgagtgtattttgtgaatctgtagagataattcagtccgaatgagtgtaatagtattcaattttggaactaccgcgtaacattgaaatcatagcctgttgaaatggtagatataaaggaaaatccccatggaatttagtgcattgactaataagaaagatttacaactgaacttgcttgagctttcaagaatctgtgactgtcgggagtagatgaatttaacagaaccataaaacatgctcttcagagacctttcgtcacattaattaattggttttagtttttcttttggcgtatcttgacttatgtataagttgctatcctttctaatgatgctgttttttttatgttttctacaggatgatgtgcaggctgagtctgagagtgatgaagaagaccaacaaatttataatcctctgaagttgcctatgggttgggatgggaagccttttccttactggttgtataagcttcacggccttggtcaggtaacttttttgggagtgtatggtaggctgcctgccctttgttttgatgtctgttatgggtcgatgatcacatttttaactgctacttttttccttcttttttccttgagtgaatttttgttgtatttgcggtttccatttatatttttgatgttgacatgtgttatctccttgcatagttccaaggcatgacttaaagattagtgtctcggtttttagctcttgaataggtgtttgacttgtgtaatctttgcttgggcatatatttgataaattagtaacatgtaatcactatgagagaattctctcaattgaagaatcatctggtcagtcattttcgaaccaagggtttaagtcagctaaagtacttatccatatcaatgaaactacagactttaatgattgtgtagatgattttgatttaggataaattactagaagaggttgtagttactgttgttgcaacagaagagatgttgataaaagaatatatagccatattgattgggtcatttaaaatgtaaaatggtacaacaaatttatcagtatttaagtatatgaagcctgaatgcttagactattctctcattgtactttatactaaagtgacaaccaaaaagactaaataaccttttacattgttacgctttctgctgaaacactgcgtttcaaacaaacggtacacatggtatgggtggcttcaagacaggacatactatgtttgaactatggagcaaactaaaaaaaattgtgatgcaaaccagaggcatgatcaaataattctcctctctagggaacagatcgataatctgcaggtgaaattaaaggatgtgtaggttagtcttaatgctaacctgttgaagtgtgctgaagccagagcttcgagccatacgaaagcctaaaattacacttatgccaaagcgttaagtacgtaatggaccgaggcctgcacagtcagctgttccaaaacaaaacctttcccaaccattgcctttctgtccctcttaaacattgttggcttcccccatcttttgcccattactcccgcagacatcttctttatgaattcagggtctgctatgtaaacaaatggttctgttcccagccagtatgtaaaacttttcctgcatatatataaggaatgcttcaatgaacaacaaaatagtatatatacctattgtacgtagttttaagttaatataaataagcaactaaatataccatgcaatttctgccacttagcgcagtatacaaatgccaatgaatggatatcatggctaatgcttaaggcaaaaagagaaagcatgattagaaagtaagtaatttaaaactatcaatgtacaataggatatttaggggcgcgcacatgtacagccaaatggaagttcctgaatcagattgtagaaggagtattgttatggttaatgttgcgagagagtaagaaggataactctttggggtcgcgcacatggacagcgaaatggcagttccacaactgctccttcattgcagcttacccagtcaagttttacagctaattgttattatcaattcctacgattcctacataggttggaccctaagatgtaaactgttccgaagccactccttttcccctataccaaagcctgaagtaccaaattttccgagtcctaacctgtcatctgtcccaaaatctgagttaccaactatggcaaaagctaagatcccagtcaatatcatactttcaatgtaccactatattagtatgcagcataataaattacacccaatatctaataactttcaatttaccatattgtacattgactatcaacatatatgtaaatgcaacctgcatattgtctggacgacaatagtaggaaggtatctgaaaagtccacatattccatagaattttcatggtggtgatgagggcagagaacttattattggcaatggttgctcttgctcatttagaacaccaaagaaactaccaaataataaaaagaaatattataattttcaagctgcacttatttgaatttctctatagtacactttttggtcttgcaaatttatgcctactgtttggttggtactaccgcctaggatatttcgaaatcctctcttctaacttctgtaaaatattttcaatatattatagattcttgtggagttcaaaaacaaatatgcaaatcatgttgagtgggcaaagcctttgaaagaactttatctccctggctttagagattatgttatgagccactatccattaggtcgtgtatggagtgagacagggaaagctgctgcatctgcaccatcaaaagctccttcaccaagtgctcctgctcctccggctccaccaccagcttctctcttcagctctgaatatcctcaggcttcatcatcacttccaagcaagggatggctgctgtttttgacgaaattaattcaggaaagccagtgacttctggtaatttaccttcccaccctcctggataataaagatagaagtttacccttatttgaatatttccttttaggattgagaaaggtagcagatgatatgaaggcaaagaaccgtgctgacagaacggacgttgttaatgctggtgaaaaacaagcccgcattagctcaccctgtatctctaaaactggacctgcaaaattagagcttcagatgggtcgtaagtgagtaaagaataggcatcaattgcaggaaaattgatattctgtcagagttggagagagtggctaacatcagtatacctagagatttttccagtgaagctgctaataactacttgctacatgtatgtgaaatgtttgacgtcaagtgtcctccacctcaaccacagcgcgattgctcgataagctcattttcctgccttgccaaacaatgttgttgtcatttctatagcttcactaaagctgcgtgcttcaataccacatcatagacctttttatctgatgacaatgtcattccaaattgctttctgtgtcagctcagtaacttcttgatgtttttaataggtggagagatgagaacggacacattatctacaactccatcaactttcattagaccgagggaatcaaaatgcagaaaaggtcactatctatgtttatgacagcggtaattaatcttctatttccttaatagctttacaaatttaatgttttaccacaaatactttcgacaggcacaataaaatcgaaaacgagggagcaaatctgtaacagaaaagctacagatgatgtatataaaaaaggctacataaaccataaggcactgctatcactgagaataggccttttaacaatggtaaggcctcttttgcagatccaaacagcaatcaacagatttggaatcataaccatatagtttatcccagagaattcctacaagtggagctgcaaaggaagaaaatgaaacctcataggcgcgagcaaatgcatagatcatggtcctgtgatttgaaggttggagcagaacgaaacgaaatttttttttgcagcagttaacaaagtacaggtaataaacaatacagccgtacatcaaattgctttcataactgtttgcataactaatgtcactcagaggcaacaatcatgttcgatagatgtgcatttcatttaccaagccaacggtctcatcatttatttattttgacatttttaggttgctaatgaagatactttgttgatcgacattgcaaacaaatcaggcaacataggtatatctattgccacaatagacgtcgaagaatatttgaattcacacttctttggaactaagatcaacagactatttaaataccctctgtcattttcatgataaaaactaaacctcacgtctatttttggatatatgtagggagttaatgaagttaacgattttatcgatattgcaaccaaatcagccaacacaagtatatttgttgccgcaacagtggtagaagacgatttcaatgcacgcttatatcgaactacgtcaacagtgtgtttccaagacaaaaaacaccttaactttttgtatatgtaatagtttgagacaacaaacacatttgtatatgaaaggaaattgttttagctcaattgttatgcagaccttattttaattatttcatttggagaggattaaggattcttttttgacagacaatgtgacagttaaactcaaaaatgaagtaatacaattcttcatccatttactagagcaagaatatcacaatgtcttaaacgtacatccattttgtatcttcaatgactttgttgtatcttgaatgggatgtttagatgattttgttgctgctttttcattgctctgtatatacttaagtaatctaagagttaaaacttattgggataacatttacattcttacccagatattgttttagtattttgaagcaaaagagaaaatactaatttaattaaccagaaatttgctctacatcatcatcatcagtggctacctccagcttttcaacatttgtttatggtattcgatggctattttcagaaaattttagtttcaacgtacaaaaatagatcacacaaaaatacatatatttgcacgagtgtaagtgccacaaacaattaactttgttaaaaaccccacgctcagccactacaacacaaccctccttaacttccatccatcaccttaagttctccttccacaactctactcattgaacacccacgatcagccattttcatacagcaactattcgacatcaaacagttgtggccttcccatatacacccctcgatttcccactccctaaactcactttcacctcaattccatcacatctccattaactgattatccccacgttgatatctacccacttctccactatattcagccgatgatagtataaatacatagaaacaggaagatgtgaaacaacataacgctacagtgtaaggcaatcgtttccatctcacaaaatagtacgaaagttttgcttcttctacaaccaaatataacggtatgatcaccttcttgcatatattcgatttaccttattgatcctaatatttagtttttattatcacagtttatacattatatccatatttgctgatttatcttctttattcaacaaggtagtttttttatatataaaaaatatactatagtttgatatgtaatttaaacgacttatatcaactgccttttatggatataatggtttgatgaaacagtttttaagtagacctaatgtactgatttttgatttgttttctgtcattttgtagctgccaatgtttcgattatgcatactttttacaactacatgctgctttatgtaatccttaacgggtgatatactacttacatagtttgttggataataagtaattttatgctgattaagtggggaaagcatgagctatttacacctctaactggataatttttgtcaagatatatattttcgtggtgtatccgattattagattcgcaaaataagtttagctacctcttgaatgtaaacatttatcgaccatggatattaagggtatttcatgaccgcttccgtcacttttctatgcaaaaggaagaaaaacaaactcacatcaatagttgtattggtatatatatatatatatatatatatatatatatatatagtataaactaatcttggcttttacaatatcaaatatttcaatattcgtatgttatatctacaattatagttttccttaacccttttcagatatggctaaaaagggagacaataatattactgtaacttcaacttctcaaagtcaaggattgctacaacggtcaagggtacgtcgtcacagcatttattcctttaagcgttctgactcaaaggctgaaatcatccgcaatgtaccaaggccgatacaaaaaaggttaagagatgcaagagctgcaagaagagaaacagaaaagaaatatagagaaattaggcctacactagatgtacatattgcaaattataagattaaacgagatgcactaatagatgctatagataacattaaactatatgattgggaagcattagtaattttagtagattcacttgcacaaccgttaggtagtattttaacagacatttatcacgagatttggccgagtcaacgtttttgggtttatattcatatatttgaagccgagtgggagatccgtctgtatgactacctgtaattatttttataaatgatagtttttatttctttgcaacattacctgtcatttggcttaattttattttaccattatataatgtaaattacatcatgtaataacactaaatgtaataggaccgactgtttatacttaattattaaatacattatatgagattacacatacattctgttaattattcattttttaaatttttatttattaaatcatataattatattaacttaagttagattaatgtgtcattgcatataacacaatatcttacggcattttaggctatctaaaataaattaacccgaccttacttgccttattataaaatttcgtcgatcaaatggtttacattttacgaatgatcatgttatacaaataggaggtgattaaacaactaagttaaaaatttattatatttttccaaacgtattttccgcgcatcgcgcgggtactatactagtatatatatatagacactctaacatgacctaactattagttttgcctagagaagtttaaagtttaattagaagactattccgtaatcatatattagcctatatcatccgaagagctgatattatttcgcttatcaagaatttagttatttaactattcatttcaaaaaaggaaatcttcattatataacaaagatcgctcgtatataaccttttaaagcaaatcatattgttttagaaattactagtcttagtgtacgtgctttgcgcgtgtacctaactcaacgaataaaaatttatttaaaatttatctttgagttataaaataaaatataacttctaaagagataactaaatcgctctacaaaaatactcaatcaccggtcaataattcaatctaaaatatattgcaaagaatgactgaaattagaattggaagtgtgtagttagttttgaagtgccattataattttaaaattttaaatattaggaaaaataaataaatgacaattttgcacaatcaagctagatgtgcttaatatctagtaaagaaatatttcggatttgataaaaactatcttattcaatatggactataattttgaagaaatatttcatcttttaaagagtataattaagtccacttttgttttcaagtttcaagcaaacaatgcgagttaatgccaactaaagctcaatgcgataaatttattgtagtttccagagtataaatgttagaacactcaaagtttaactattaaccgaatgataaactttataaaaaaaaattgtaaacttcatcataattcataaatcatagttggactacttttctctgccgatgaaccaacagtgcttcggattgatctagtaatctttccaacatggaaaattaacttgaagtatatttagacgttgagagtaggggtggcaaaatggttcaaagaaaacagttaaccatccatattatccactaaaaaatgggttggataatgaacattttaaaaacgggtcaaatatggataagaaccatattatccatttagaaaatgggtaatccatgagtaaccaatggataatcaatgagtttaacttttacatttgtaaagcatcaaattgggggttcctcaagttaggaagactaaaaattcttgcaaaagtgatcatatacaagaagtcatggataatatgggtaacccatattatccgccggttaacccgttttttatccgtattaaatatgggtcgggtcggataattaatccgtttttttattacccatttttaacccgaactatatccgacccgacccgcccgtttgtcactcctagttgagagcatggatgccaatctgcaaactatttttaggcaagcaagcatactgttgcagtgttgctcctcgtggccaggttctagtaaaaagcccatttaatctaagatactaatccttaatctttttggtttcagattatcgagtacgaaccccaaacaaactcatgctttgcgcatccggactcacatagtatagaatacgttttgtcaaaattatattgcattataacatcgcaataagtaataggattaatataaggttataaaatcttatttgatttcaacttcctacgtggtagctagtttaaataaggaaatattcaataatctaaatttacttgactttaaattctaaatattaacaaaataattaaattataattttatccaatataaaatctatttttaaagggtaaaaaaagcgaacgacatttcgctaaggaccttcgtgcttttaatatagtatagatatttgacaaacaatagttccaggaaggagagagggagaatacaagaaaaaaaatcctaagtatataaatgagatttattcactacggagtaagattagtgtgacgacccaaaggggtcctcaccggaattcttccttttcccgtgcttccgaggccttgaaaacctcgcttttagttgtctcgatttgcaagcacaatccgggcgcgaagccggaaagcttttatgttgaaatatatggattatgtgaaaaatttgaggaactttaatattaatattgttaaggttgacttcagtcaatattttagatgaacggacccggacccgtgatgtgacggtcccggagggtccgtagagaaatatgggactcgggcgtattcccggaatcgaaatccgaggtcccgagcacgagaaatgaatttttgaaagaaattattttctgtaattaattaagggaattggaaaggaaaatgagttagaagtctatggtatcgggctagtattttggttccgacacccggtacaagtcttaaatatgtgttaagcactatctgtaaattaattaagggaattggaaaggaaaatgagttagaagtctatggtatcgggctagtattttggttccgacacccggtacaagtcttaaatatgtgttaagcactatctgtaaagtttggttgaaaacagacatcgtttgacgtgtttcggactaaaaatggaaaatttaaagtttatgaaagtgaaggaagaattatgtgttttgaggtttgattcatagattttgatgttattttggcaatttgatcgcacgagtaagtccgtaggatatttttgcggttgtgtgaatgtttggtttggagccccgagggctcggatgtgttttggataggcgttgggttgcattttagccttaggaaaaatctggtatttggcttctgtgattttcgcaaatgcgaaggggaagctcgcaaatgcgagtctcgcaaatgcgagcttttggccgcaaatacgaaggctggaaagctgggcgtggatcgcaaatgcgaggacttgctcgcaaatgcggagctggggcaatcgcaaatgcgaccagaggcatcgcaaatgcgaagacctcaggacccttcagagttcgcaaatgtgaagctcgacttcgcatttcccaagcctgctgggttcgcaattgcgaacccagcttcacaattgcaatacccgcacttgcatatttcatacttagacgattttaaagctcatttttaatattttcaaaatccaaacacctattggtgatttctcacgaactccctcttctacaaatcatttgtaagtcaatttttactaaatttcctcaatctttaacatcatttatcatgttttcatcttaaaatcaagatttttcatgggtgaaaatggagattttgggtagaacttaggttttcattaaattgggaatttggacctcaatttgaggtccgatttcaaaataaatcatagatatgaactcgtggggaaatgggtaaccgagttttggttcgaacctcggattttgaccacgtgggcccaggcgttttgggaatttttgggtaaaactttggaaaattcattcgtatgcattcaaattgatttaactagcatttgttgatacaattgagtaatttgtgactagattcgagcggttttgtggtgaattcgaggggtaaagctatactagaggcttgagttgagtttggagctttcgaggcaagtgtttgttctaactttggcttgagggaataggattaggaggttatttgctacttgctaaatatggaatacggtgtataggcatagtgacggttatctatgcatcggagtctagcatgaccgtgagtcctatttgtgtttgattcggatttggtgaaacgttttccttgtttaattgttaaattcatataaagtgaatagttgagaagaatagtgattgttatgtcactggagcgttggctcaaactagaaattgttaattgagaaacaagtgaataaaaaaggaagtgtcgtgattgctcccttgccgggatgcgtggtatattgttgttgttgttcccttgtcgggacttagtattgttgttgtattcccttgccgagacttcttgtgttaattgttactcccccgccccgattgtggttgttgtttgggtgagttcgtggtacggatttagaaggatcgggttgcacgctacaacggtgttaaataatgaggatcgggttgcacgccgcaacggtgttaagtgagattggaacgggatgcacgccgcatcgaatctgaatatagttggaacgggttgcacgccgcaacgaagtgtggcttaagtgtgctgccatcatatgtggagttttcccgtgtttcattttctgttgttgtggaatagtgttaaatttttatccgatgatcgtatacctaatttgtctcaccccatagcatgctcccttccctcttaactgttcatattatgtatatttccggttattgtatatatatctgcacaggttatttgtggtaggtcctgtatagcctcgtcactactttgccggggttaggccaggcacttaccggcacatggggtcggttgtgcagatgctacactctgtgcattttcatgcacatattagggagtagctttcagaccgcagcactaggatttttgggagctatcttcagtccagggactctcgaggtagcctagctggcgttcgcgggccgaagtcccttctatgtttagtttgtttattttgtatcggacaaatattcatgtatttcctttcagacttgtatttagcattctgtagtagttcatgagtagtgacaccagactctgagtagaagtgtactgttggaacttccgcatttgttcttctgtatttcaattttaaagacttccgcttattttacctgctttgttttatttatattatcgcaagtgctagttaagagtgttttattgttggcttgcctagctcctaatagtaggcgtcatcacgactcccaatggtggaaaatccggatcgtgacaagttggtaccagagcactaggttacttaggtctcacaactcacggacaaactcggtagagtctgagggatcggtacggagacgtctgtatttatcccccagaggctacagagttaggacaaatttcactttgttctttcttgtcgtgcgattctgtttctcaagtactgattgtctttcttctctgttcttttgcagatggcgagaacacgtgcttcctcttctaccgcgcagcagcctgagcccccagcaacagctcctatcaggggtagagggtgaggccgaggccgtgccagaggctgaggccggggcagagctcagccccgagtggcagtcctagaggtggagcctcatgttgactacgatgaggaggttccagctccagcagctccagtgggcccagcttaggtcctagagggtttcatagccactccagtacttcaggacaccttggtccgactggtaggtttatggagggaatttctagagcgggtttgcttcccatagcaccagccacatctcaggctgggggaggagttcagactcccgctactcgtaccccagagctggtagctcctcaggctcaggctccagcagttcagccagttgtggcagttcagccagctgtggcagtctagccaggtattgcagctcagaccagtgacggtgcggctatgtccgctaatgctctgtggaggctagatcggttcaccaggctcttcactaccacatatagtggcactccttcagaggatgctcagaatttcatattcagctgtcatgaggttcttcggactatgggtattttggagaccaatagggtcgacttcgccacttttcgcctagcaggatccgccaagacttggtggagagatttctgtttagccaggccagcagggttgccatcattgacctgggatcagttttcagagttatttctggggaagtttctcccagttactcagcgggatgccctccgcaggcagtttgagcatctcgagcagggtactatgacagtcacccagtatgagacccggtttattgatcttgcatgccatgctactgtgatactccccatcgacagtgagagggtgcgggggtttgttgatgggttggctcagccgatccgtgttcagatggccatgagtgccgggagtgagatttcatttcaggaagcggaagatggtgcctgccggatagaaatggcacttgctcagggaggtggtcatgggtctgataagaggccccgtcattctggtagattcagtggtacctcgtttggaggtagggattcctattgtagaggccatcctccgaggccctttcagtcagctctccaggtctctcatggtacttcaggtggcagtggttctcggccgtattattctgagcagcagtctttcggtgcaccgcctgctcctatcagtgcaccgccacttcagagtttctgaggtgatcattcatgtcggcagggtcagtctcagttttcttagttgccgtatttagatgggtgttttgattgtggagattttggtcacatcaggagatattgcccgaggttgagaggtgctcagtcgcagaagcagggtcctcgtcctatgattcaggcaccagttgccccacagcctgcccagtcagcaacactaatagcagaatttctaaaatgctccaagttccggaatggcttcgttgagcatccgaaacacacccgaggcccctgggacctcaaccaaacctaggaacataacccataacatcattcaaacttgtaccaatccttaaaccacctaaaacaatgccggaaacatgaattaatcaatgatttgaacttagaaattccaaaacttaaccaaactcgctttcgatcaaaaacctaaccaaaacacgtctgattgacctgaaattttgcacgcacgtcccaaatgacatgacggtgctacagaaactttcggaatcccgttccgaccctcggatcaaatattcactatcggaccggaaacttcaaaattctaactttcggcaattctaaccaaaatgagctacggacccccaaaatacattccggacacgctcccaaccccgaaatcacctaatggagctaacggaactatcagatttccattccgaggttgtcttgacactgttccgactacggaccattttccaacacttaaactctcaaatagggactatttgtcccaaaacactccggattcaaataacgaacatcccggcaaaccaaaataacataattaaacttagggaaagcagttaacggggaaacggggcgcaaattctaaaaacgaccgaccgggtcgttacatcctcccacacttaaatattcgttcgtcctcgaacgagcatagagaacatacctgaagcagcaaaaagatgagggtaacggctgcgcatatcccgctcggtctcccaagtcgcctcctcgatcggctggccccgccactaaaccttcactgagactatctccttagacctgagctttcgaacctgcctgtccaatattatcacaggctcatcaacataggacaagtccttgtccaactggattgaattgaactccaatacatgggacggatcaccgtgatacctccgaagcatcgaaacatgaaataccggatgaactccggccaaaccgggaggcaaggcaagctcataagcaaccttcccaattcgcctcaaaatctcaaacggaccaataaaccccggactcaactttcctttcttcccaaacctcatgacgcctttcataggcgagacccggagcagaacccgctccccaaccataaaagaaacatcacgaaccttccggtccgcatatctcttctgtctggattgggctgtacggagtcggtcctgaatcaccttaaccttttccaccgcatcctgcaccaaatccgtacccaatacccattagtcatctagacttctctattacagcatccttatataacaccctttcattataaaagccaaatttttctttcctacagtggattatgccatattcaatatttacagcaaagattgcatataggtaattatttattagtattccgtaatcatatattagtctcatatatactattccgcaaatttaaaccctttataatgaatattgttaatctgtaacttatgccatattcaatatttacagcaaagattgcatataggtaattatttattattattccgtaatcatatattagtctcatagacatactattccgcaaatttaaaccctttataatgaatattgttaatctgtaacttatgccatgctctttaagtctcagatctatctacgctacagcaacaacaacctagtataatatcactagtaaggtctgaggagggtagagtgtacgccgacctagaggatgtttccggtagaccctcggctcgaaaaagataaaagaaggacaacaacaaccacatcaatcggaaaaccagagcaaaaatacaaaaccaaccgtaagtattgtaatcagaaaaccgaaacgaaagcaacaagtaataacagaagtcaaggggtatgacaatacacagacatcacaacactcggctacctatcttaaccctttaccattattctcaacctccataccttcctatccatggtcatgtcctcagtaagctggaacaacgtcatatcctgcctaatcacctctccccaatacttcttcagcctgcctctacctctcctcaggccctccagggccaacctcttgcacctcctcaccggagcatctgtgtctctccttatcacatgcccgaaccatttaagtttcgcctcccgcatcttttcctccacaggggccacacccatcttgtcccgaataactccgctagtagggtaaaaaaacaagggagagaaatgaaatgcaaagatgagagaaagcaatggcaaagccagcaatttcattaagaatgatcaggactgttccacattcaatataatgtatacaaagtaatatttgacctatatacaccgtacaattctcaagcaaaaggtatttaactggcctcccttgacctatatgtagctccaccattgcaaggaattattagtgtatttaaaaaggttttcaaatggctacaagaaggatccgttagccaagaaggatcaacagtaatgacatttcgcatgtactgacgatccgttgaaacaagagaatggtatactatcaaatttgagagaactcattataaacttaagatgtaacagaacataataacacttcaacttatctagttttattttttcctattttatcctaaagtaaccagggacaatatccaaatatgctataataggatgcaacaatttggaacatccactgttggttaactatgcattcgactcaacaagtatagccttaaaataaaagaaatgcagcacctttctttagagcgtatagcagaagtgaagtaataagatagttccttggactatcgcaaccagtcttatataaatgaatacctgaacagcacagatgaaggatgaatatatataaacttcttgagaagttctgaacttcttgttgtaacgacccagccggtcgtttcgtttcccccatttctgcttcttattgctttgttcatctgtgttatatggtatcgggtttgtcggttcgaatccggaatggttttggtaaggtttgagacacttaatctctaaagttggcctttgagttggaaagtcaaccggatgttgatatatgtgaaagggctcgaatgtgaattccgatggttcggaatgcttcgagaggtgatttgggacttaggagcgtgatcgaaatgtgttttggaggtccggagtagatttaggcttgaattggtgaaattgaaattttggcgtgttccggttgattggtgagattttgacataggggtcggaatagaatttcggaaatttgagtaggtctgttgtatcatttgtgacgtgtgtacaaaatttcaggtctttcggacaaggtttgataaaccttttgctcaaaagcggaattcagaagtttttggaaccttaggcttcaatccgatgttatttggttaattcaatgttgtattaggtgtttcgaagattagtataattttgaatagtggtatatgacttgttcgtgcttttggttgagatcccggggacctcggggtgatttcggatggttgacaggaggtttgaagttggaatttggagcttaagtgctaaaactcctgtcataaccgcacttgcaccttggggaccgcaggtgcgggctcacagaagcgcctagagggtcgcagatgcaaaaatgactgtggggagctggattcacaaaagcggttgttcgagcgcacctgcgatagcgcaggtgcggtattatgatcgcaggtgcggtcctagtgccattaagtggtttccgcaggtgcgcacctagaaccgttggtgagggtccataggtgcgagattttgtaccgcagaagcggtttagctggggcataacatatatatttggcccttcgcgattttgagtgatttttcaccatatttcattcgggagaaagctttgaagagggaattcaagggaatttcatggaggtaaggtttttggaccctaaacttgtttctatgatggtgtttgactgattgagcttgaaatctatggaaattagtagcaaaaattgggtgtttagggcttgaaaattggagaccttaatctaaggatttgaggggtcatttgtggttggattttgatattattgatatgtatgaattcgtgagagtgtaaggattctagtttaggcatggtgacgagcatatatacgtcggtgtcaagcaagcacatgagtcttgtagtgtaattgttgtgactccgttgttgtttattcatgcttcatatgaagattatcattattgttcccttgccgggatgttgttgtgatattattgttcccttgccgggatgttgttgttatattattgtttccttgccgggatgttgttgttatattattttttccttgtcgggattcttttatgattggcgttgataaatgaaaagggagcgggctgcacgcctgcaacggtacaatatgaaatgggagcgagttatacgtggtcgtcaagtaataaagtgactaaaagtcagatgtcgatcccacgaggacttgtgattaactattaactaaattagactatcctaattatctaaacaagaattaaaactaaaattatttgattctaaactaattaaataataaaatataaataatgaactttaaatagagaaagagcagatttttatgttatcaatgtaatgaaaacgatctagggtcatgggctatctaacaatcatattgtattcttctattgaattgactaactaatttatctagtttattggttgacagggttaatattgctcataagaatctgtcgagttcttactcgcctattcaagctaacctaacgcctatatgtctatggagttagaatcaacaagaacgcatttataattcctgtaaatcaaccaagcaaggcaattgagtatatgtctatcccaattgctaatccgttccccaaggcccaggttcaagaacttgccctactcaatcctatatgcaatctagaattcccactttcgagttcaactctagattcgtagatagtattcaattggtgatcaagcaatcaaataattaagcgcaagattgaataaataaaccaatatgataaactaagaaatcaaaatcaatatccgaataaccatagtcatgaaagaaccacaaccctagaacgtgaagtttagctccacatagacatggtagcaaaacaacaaatcatacaaagaaacataaaaattacaaagtttggaggaagaaaagatgaaacccggcctccacggcggttctgtgctcttccttcgtcaaaaattactctaaaaaacgttctctcatgtatatataccaagtagggttaggcccaaacaattatacctttttcaatgtgacaaaggacctttttttcgggttttactagcgcgggcgcgcatctaggcgcgcacgttggatgacattctgtcctgggcgccctaaaactagcgcggtcacgcatctggcgcgtttgaccctgttcctttccgaatttggaaagatgtaaaacatgaaagttgtagccctttaagttatctttccaaccatatattatggagctcaattggagttctgagcaaaacgttatgtctattttacaacacagtgcgcaatctacccactggatgcttcgttcgctctaactatcatcctttgacccccaaacgcgatcccggtttaattccttgagcttttactcagatttcaaagctcaaaatcatttgaattcattttataacatctatatagctcggaatcactcctacaaggcataaaacacagttagagcaagacactagcgattaaagcgcaaactcaatcaaagtgcagtaaatttgagtgtaataagtgactaaaatacacaattgtagcctatcatcaataccccacacttaaactatttctcgtcctcgagcaatcaaactacactttatatatacacaacctttttttaaacaattctcctaactcatcacactaagaatatttaaaatagacgaagcacaaaagtgtaacatcttcacctcaagatttgactcacaagtaccacacattattcgtaactcacccactttctctaatatagagatcactgacattacctttccttcatgaatcaagtgccctcacacaacaaaagagagtagttccacacaataaaatttaagaacacttaggaactcaagatagaaagaattcactcactctcagaaataacattcatatgccacaaaagatgcaccatatgcttgcccgtagtgtactactctactaatcgagctcattcagtctaggatcaagtaggactttatttggttgtaatgtaggctacgggacgtgtatgatacatttagatataatagcgactaaacctccctaagccctttaatacatacactttaacattcaaaatcccacacttatgtcaaaccataactccaccttcacatcaatatatattaactctcacttctttaagcacaattacatcaagagtcactactattacagaatatttttacatcaatacaactattttttttcaattcaagtggctcttgatctttcaaaacagtgcacctttctccttattcagttagttccactcaaaagccaaaccaaccacccctcactttaacttttacaaagttcataacaattcaagtgctcatgagaggtgaaaaggttcaaatatatggttaattcaaataaatgggtaaggcttgtaatgtggttgccaaaagaaacaggattacaggctcaaaggggttaactatgatacataacaattaggcgggtaaaatatttatatggctcaacaaagaaacgcctgtatcatttccaagactgaacaaaactactatttcgctttgcaaacacacggggcaagttctagacatcaaatgcaatgcacagaataacacaaaaccttacacacacatgacacataactcactcaggtatggactcatccagacactctagtcaaagaagttaagcaaagttaagatcatacaatttaaggtacttatacaagagtaaaaaactgagcctaagcgtcacaactaaagtactcactattctcaaggcataacaaagtcaagagatattgcttcaattcaaagcacaacatcatggcttctctccttaaaaaaaaataaaattacctatacccggttcaaataaaacccttgaaaaagaaccgtggcccaaagaaaaactaagggggagttactacactacctaaaacaaaacaaaaaaaaatctttttggtattttctttagactaaaatccctcaagaaaattgtctaaaggatccgtcatcaggaagagtctacatatttttcgattttttttttcttttgaataattactacactatgaacgagactaaactaacatagcacagaaaatcacccagacaatttcttcaccccacacttaaaattgtccaatgtccttaatgcacactaaaaataacaagagggtacaagaaactccctggtaggccaaaggccaaagcattagcagcttacgggatactcagacttctcccaggcacgatcctttgtgcgggtacctcacactcagtttcaaccgcctgctcgcttttgcactcgcctattggctttgactccgttctcttactcctacaaaacaacaaaaaacaacactacaaatataacacaataaaaaaattaaaaaaaggaaaaaattaaaatcgggttgcctcccaacaagcgcttgatttaacgtcgcggcacgacaccatcactttcaccacttttccttccactttgaggatataaattgcgcccccatttttgcatcaatttttctatcatgttcatgaggcggtggtgtgaaaataaaggaaccaagtaaataatatcgcatcttgcacttcttggcccttaagtgaggtatgtcgtttcgtctccttggtatggcaaatttcagaatataagcactttgttcctcatccattgactcctccatatgctcgactggatcaattcccatatcaccaaccaaacaccatgttgaaaagtgtttagaatgaggtccaatacgctccaattccaaaattgcattacttttgacatcctcaattttgcgttcttcgtcaaccttggcatcattaataatattttggtcgaataattgaagttcctctttccgctccacaagctggccagtatccacaaaaattggttggagggcatcagatgcctcaacctttttattcaattgatcatgcaagttatggatatctaagccaaattggtctatctcttgcctgagctcagttcttgcttctattagttgttcggtcacattcgaaagaccatcacggagaaactcgtgagattttatcttttgagcttgttcctctagccaagattggcttactatatctgcttctccaaacaatcttcttgtgggaactaactctcttcatcgaattgaggttcttcttagaaattggctatatatgcgtctattctagcctggagtcttttgatatcttttttgagttcatccttttgctctgctagttgcctcagaatatctctagtatatgcatcaggttccgtatcctgtacttcattgctcatatcaaactcataaacattattagaaacatcataataaaagctctgagaaggataataaaaattaggacaaccatcccaatggccatcttgaccaccacatatatgacaaatattccactcaaaggattgaaattgtgtgcacaactcgctccctggaatattctgataatttttccacaagtgaggtcctccacaatatggacaaggatcatcataataagaataaccaatattcgaccaattctcattccaataagccatgtcaacaaatataataaaatattaaactaagataaaaataaaaagaaacttgattagacaaaaagtaaaaatctaatctagtagactagttaatttctaagtccccggcaacggtgccaaaaacttgttgctcccaaacgcacacgcaagtatacgcggtcgtcaagtaataaagtgactaaaagtcgaatgtcgatcctacgaggacttgtgattaactattaactaaattagactatcctaattatctaaacaagaattaaaactaaaagtatttgattctaaactaattaaataatgaaatataaataatgaactttgaatagagaaagagcagatttctatgttatcaatgtaatgaaaacgatctagggtcatgggctatctaacaatcatattgtattcttttattgaattgactaactaatttatctagtttattggttgacagggttaatactgctcataagaatctgtcgagttcttactcgcctattcaagctaacctaacgcctatatgtctatggagttagaatcaacgagaacgcatttataattcctgtaaatcaaccaagcaaggcaattgagtatatgtctatcccaattgctaatccgttccccgaggcccaagttcaagaacttgccctactcaatcctatatgcaatctagaattctcactttcgagttcaactctagattcgtagatagtattcaattggtgatcaagcaatcaaataattaagcacaagattgaataaataaaccaatatgataaactaagaaatcaaaatcaatatccgaataacaatagtcatgaaagaaccacaaccctagaacgtgaagtttagcttcacatagacatggtagcaaaacaacaaatcatacaaagaaacatgaaaattacaaagtttggaggaagaaaagatgaaacccggcctccacggcggctctgtgctcttccttcgtcaaaaattactctcaaaaacgttctctcatgtatatataccaagtagggttaggcccaaacaattataccttctccaatgtgaaaaaggaaatttttttcgggttttactagcgcgggcgcgcatctggtcgcgcaccagggcgcgcacgttggatgacattctgtcctgggcgcgctaaaactagcgcggtcgcgcatctggcgcgtttgaccctgttccgtttcgaatttggaaaaacgtaaaacatgaaagttgtaaccctttgagttagctttcgaaccatatattacggagcccaattggtattttgagcaaaaggttatgtttattttactagacagtgcgcaatctgcccactggatgcttcattcgctctaactatcatccgttgacccccaaacgcgatcccggtttaatttcttgagcttttactcagatttcaaagctctaaatcatttgaattcattatataacatctatatagctcggaatcactcctacaaggcataaaacacacagttagtgtaagacactagcgattaaagtgcaaactcaatcaaaatgcagtaaatttgtgtgtaataagcgactaaaatacacaattatagcctatcatcaacgactgcaacgatactatatgaaatgggagcgggttgcatgcctgcaacagtactatataaaatgggagcgggttgcacgtctgtaacggtactatataaaatgggagcgggttgaacgcctgcaacggtactatatgtaatgggagcgggttgcatgcctgcaacggtattatatgaaataggatcgggttgcaagcctgcaacggtattacatgtgtacttgattcttatttccttatcttttgcgggtaattaatttatggcgttcctttcatttcgctattgttattatgttgttacctgttaccccctgcagcgtgtttcccctgcccaactttagttgtaattatctaattttatttctgttgtatatgatttaactgcacaggtttatttagtagtatggtcctagccttgtcactattcaccgaggttaggctaggcacttaccagcacatggggttggttgtgctgatactacactctgcactgtgtgcagatattgataccagagcgcttgaaccgcagtgagggtgctgtcttcagtccatctaggcgacccgaggtagtcctgcagccgtctgcgggccttggcgtctcctcctatcttttctctttctgtttttacttatttagagacagacttgtgtatttccattcagaccttatttgtagtattcttagatagtccgtgacttgtgacaccaaattctgtgtagtattgtacttcagattatgtagcaatgtttggttgaactattaagtttttcgtcttccgcatttctagttatttaatttattctgccatttaatcacttatactttgaattgtctaacgcttaataataaggctaataattttataatattcggcttgcctagattccacaagtaggcgccatcaagactcccgagggtgggaaattcgggtcatgacagttggactcccacggactcagaggaagttcaatgcagtttggattattgtggatagattgaccaagtcagcgcatttcatacctgtggcagtttcctattcttcagagcggttggcagagatttatatccatgagatcattcgtcttcgcggtgtgcccatgtctatcatttttcgatcgaggtacgtagtttatctcgcatttctggacggcaatatagcgtgagttgggtacaagggtcgagttgagcacaatatttcatcctcagacggacatacagtccgagcgtactattcagatcttggaggatatgctctgcgcctgtgttattacctttggaggttcttgagactgttagtggagtttgcctacaacaacaattatcattcgagcatctagatggctccctatgaggcattttatggtagatggtgtcgatcggtggttgggtggtttgagctaggggaggctcagttattgggtacaaatttggaataggatgccttggataaggtcaagatcatttaggataaacttcgtatatcccagtccaggtagaggagttaggctgaccgcaaggtttgtgatgtgtcattcatggtcggatagagagtgttgcttcgggtatcacccatgaagggtgtgattcggtttaggaagaagggaaaattaagcccttatatcgggccttttgagatccgtgagcgagtgggagagtggcctacagacttgcgctgccaccaggtttatcagtggtacatccagtattccaggtgtccatgctttggaagtatcacgataatccatcctacgtgttagatttcagcactgtccagttggaccgggatttgacctacaaggaggaaccggtagcaattctagaccggcaggttcgtcagttgaggtcgaagagttacccttcggttcgagggcgaacaattattttagaggtggagaatgtgatgacccaaaatgtcatcttatgttttagaactcgattccgtgttttgaggcctttaaaaccttattttattccttctcgatttacgtgcgcagtccgagcgcgtttccaaaaatcttttctatgaaaaattgatgaaataatattttttggcctaaaaagttgattttgattgacttcggtcaacgttctaagtaaatggatccgaacccatattttgacggtcctggtgggtccgtagtataatataggacctgggcatatgcccagaatcgaattctgaggtccctagcgcgagaaatgaatttttgattaaaattgaaagactgaaattataatggtttaaagaaatttggtaatgtttgatcttgttggtatcggatccgtattttggttctagaacccggtacaggtccattatgatatttataccctatctgtgaaatttggtgattcaatggaactgaattgacgtgattcggacgtccagttatgagaataggaatctcaaagcgttctttagaattctatgtgatttggtgctaaattcgtagttttaggtgttatcttggcgatttgattgcacgagcaagttcgtatgatattttaagacttgtgtgcatgtttggtttagagctccgagggcttaggtgagtttcggataggctacggagtaatttggaacttagaaaaagttgctggtgttctaaagctatgttgcaggcctcagatctcgcaaatgcaagatcaaggttcgcatttgcgactactgttgaggtcgcatttgtgagtttctcatcgcaatgcgaagagaagttgagccagcctatgttcgcaaatgcgaacaactcttcgcatttgcgaagttgatctaggaagggggtccttcgcaattgcgaacagttagttcgcatttgcgattgaagcagaaatgcgacaggttcacatttgtgatactttcctcgcatttgcgagtttcgcaatagcgaagttctggtcgcaaatgcgacatctgcagctgtgtaaaagggactgagacgggatttttcaatcattcttcaaattttcaaagcaagaaactctctaggcaattttccaaagactatttcttccccaaatcataggtaagtgattcctaactcgtttctttcaatctttcacttcattttacaagaattcaacgaaaaatctagggatttaatggtgaacagtgggggtttgggtagaactaggggtttttgtataatttgaatttagacctcgatttgaggtcggatttcaaaactaatgatatattcaggctcgggggtgaatgggtgaatgggttttggtctgaatctcgagttttgaccaagcgggcatggggtcgatttttgacttttgagaaaaatgttggaaaacttataattatgtattggaatgaatttctttagcgataattgatgttattaaattaattattactagatacgagtggttcggaggtggaaactataggaaaaacgataattgagcagtgagcggcatgtggatcgaggtaagtgacgtgtctaactttgactcgagggataaggaacccttgaattaatttctatgtgaaaatccatgcgaatggcgtataggtgaggtgacgagtacctatgcgccgccaatttatctgttttacctgtttttctttccgtttttattttattgtcttccctaccttaattgctacatgctttactattacttcacgcttaattgctacttgttagatattgttatccattattggaggaattagctacaccgtagtttcatcatttcatattgttggcttaagctggtttatcagtgttttatggtataatttggattggtctcgctgagtagtattaattgtgcaaagcttcataatgtactagcttttcgttttctttggttgaagtttaattattgtggagagttgagttaaattgtgaaatttctgtatttattgaatgattggtactgatatggtaggatctgattacgcgccgcaacaggaggaataagggtgatatattgaggaggaataagggtgacatgttaatgtcctgtgggatcgggttccacaccgcaacaagatgaataaggatggattaatatggagtaataagggtgaatatttaaatttatattgattaaatggtaggatcgggatgctcgccgcatcagtttatatttttatgtatttttcttctactgtttaagtcattcttgtgacgaaccggctagtcgtctcatgagttaccgctccgatttccccatttctgcttctatatgctttttttaatccgatttatgaggtattgggttggtccgatcgaatccggaatggttttggtaaggtttgagacaattagtctcttatgagtgagtttaagttggaaaagtcaactggatgttgacttatgtgttagagggctcgaatgtgagtttcgatggttcggatagcttgggaggcaatttgggacttaggagcgtgatcggaatgagttttggaggttcggagtagatttagacttgaattggcgaagttgatactttggcgatttctgattgataggtgagattttgatataggggtcggaatggaattctgagagttgcagtagttttgttgtgtcatttgggatgtgtgtgcaaaattttatgtcattcggacgtggtttggttggatttttttatcaaaagcgtaattcggaagattttggaatcttaggcttgaattcgatgtgattttggtgttttgttgttgttttgagcattctgaaggttggaacgggtttgaatatgtttatgggatatatttgtatttttggttgtggccccggggggcctcggggtaatttcggatggttgacggagagattggaagtttggtgaatgctgcatatttgttgtttttgttttttccgcacctgcggattggggaccgcaggtgcgacaccgcagatgtggaagattggtcgcagaagaggaagacggtgaaggtggcaggaaccgcagaagcggtagaagaaccgcacctgcgatggcgcaagtgtaggttaagcatcgcagatgccgaagctgggacttacgtgaaaaactgcagaagcggttcaagaccgcaaatgcggtaccgcagaagcagggtttttgccgcagatgcgaaatccctgggccagattatatatatttcttccttcgcgattttcagagggtttcaccatttttaaacgagaattctggagttttgggaaattttgaagagagaattcaaggagacttcattgagttaaggattttggaccaaaaactcgttcttatgttgttatttcacggattagagatataatttacggaaatcaagggttaaaattgggaaaactaaggcttggtattggagacctagacttgagaatttgaggggctatttgtggtcggactttgaaacttttgatatgtatgaactcgtggggagataaggaatctattgatgtaaaaattatcgaatttcgagacgtgggcccggagatcgggttttggtaatttcgggatttgtgttgtaaattgattattttcgcttggccttcattcccttagcatattttgacattgtgattctgattgtggatagattcgacgcgagtggaggccgattcgaggggcaaagtctaggtcgacgcgagtggaggctgataaagtctaggttgacatttcttgtcttgtagtctattaaaattatggtattgtatgtacttttaagtttggattttctgaaaactagattgatattatatggaggttggtctcaaatatatggtattctataattatcaatggttctgtgaagggatttttcacatccagccaggacctcaaacgtaactaggagatcgtttgtctccttctctctttattatgagcgcggaagtactctccagacttcttaacaagcttcatgataatgacaaattcatccccatcactatgaacacccctggtactattattaatcatcttgcatatgcagataacattttaattttcactgagggaaacaacaaatccatcaagcttattatgaaacaattgagaggatatgaaaaacttccggctagaaagtgaataatgataaaagttttttcatcacagctcctaacactgttgctactagaatcaataggatgaggaaaacatcaggctttatgaataaagacttcccctttaattatctcggttgtcctatatttcatgggattttttttttttttgctactttgatggaatgattgccaaaattattataaaagattgatggttggcagggtaagatgctttcctacgggggcagaatgactaatcaatagtgtgctccaatctatgcatatctacattttatctgctatgaatcctcccaaaggctccaattcggatttagtcaaattttaatacggatactaaatatcgagcgaaaaccctttaaaaaaaactagcctctatacactttccactagttacatttttagtttgtgttttgtccttgctgcttcaacttgcaataaagtctaggtcgacatgtcttgtcttgtagtctattaacatgtgtggtactgtatgtacttttaattgtttaataagaacaaattaagtaatattaaaatgtccaataagagcaagcctattagttgaaatgtcaaaagttggtatgaaatttagggagttattatgctctcgttatagattttcgttactattttgtaagttaattttttttcaagttcctaaaagttgatttatgatagtttttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgcaaattttcaggtcattcggacctcgtttgattagtctcggcatcggttaggattttggctaagtcttggaagatttaggatcaattctttgattaaatcatgtttccggtgttgttttaggtgatttaaggtttggtgcaagtccgaatgttgttataggttatgtgtgaagggttggttgaggtcccgggggcctcgggtgtgtttcggatgctcaacggagagttggaaaggaaaatgcagctggtttctgtcataaccgcttaagcggtttattggccgcaggagcggatccgcttaggcgggtttttggccgcaggagcggctggggtcgctgcagcggaagtttgggtcgctggtgcggaaccgctggagcggttggttgaccgcatcagcggtccctggcatttttgggaaaaccgcagaagcggaaggtttccgcctatgcggagtcgcgggtgcggaaagtatccgcaggagcggagtcgctggcgcgtcaaggtgaccgcagcagcggtcgctgaggaagttaaagggaggccgcagaagcggctatttttccgcataagcgggaccgcagaagcggtcccaggagccgcaaaagcggaaatcgcagaagatttagtcttgtccgagggtttaattttcttaagttgaaaaatcatttgggagctcggaccaaggcgattttttggaggtttttgaagaggaagttattgggtaatgtttccttggccatttctagctttaatccatcatctaattgcttaatccaacttctaaattcaatttgaggtccaaaaatggaggaaaaggggtagagttcttcacctattcaattgagcttttgagggaccatttgacctccgattttgataaattttatatggttagactcgtgagagcgcgaggtttctgaaaatgtaaaaatattctgattccgagatgttggcctgaggggcgttttggtcattttacctactttcgcgtcatagctttaattttatcagcataattagtcaaatgcattattatttacacgttgtaactggtttgaatagattcgggccattcggagtcggataaccgtggcaagggcgttgctttccattgatttttgtaccggttcgaggtaagtggcttgtctaaccttgtgtgggggacctttacccctgggactgtttgttgttggtttaaacgccttgtgtgcgaggtgacgggcgtacacttgtgctatttgttggaaattcaccttacttgaaactctcaaattgtgtttcatcgctcaattgactgttgtagatttattagcttaacctgtgatagttagaaaagcatgattagcttttaattagttgtttgactgcttagttgccttcggggaagtatatgaagcatgctagactagctattcctgttatttgtgaaattcctgtctagtattttgttataattgactgtggttgcgcatttacttttggaactacggatgtgggattccggtagcttccccttgattgtttacttttgggactacagatgtgggattccggtagctccccttgtactggttatgttggactacgggacggtatcccgggaggtcctccggatatgattgatatgttggactacgggttggtatcccgggagttccactgaggcagttgtaaagggactacaggacagggatcctgggagatccctcgagtacttggttgattagtaaattgcggtgtttattctatgttttacttgactgtattattcttagaatcttcaattaaactgctgtcattcttatttatgcggttgctcatctcgtattgcattgcttatctttaccttattttatttatctcggtagggcctcgaccttcctcgtcactacccaaccgaggttaggcttggcacttactgagtaccgctgtggtgtactcacgcctcttctgcgcatgttttccatgtgcagacccaggtacttccggcacggcattccagcagtgagcccggagctgaccctaggagacttgaggtatacatctgccacgtccgcagatcctgctagttctccttctattccagctgtagttacttaacagttgttccatttaccttgtactagactttcgaatggttagagcccactatgttcaaatgttatagcctgtgttgcccgtgagtttccgggtctttgggatggtattcaggaagtttataagtgttaagtgtatgtgccgagcggcacttattacatttcgttatgctatttcggttttaccttatcttttctcattcgttattgtattccgtaaggtgttaggcttacctggtctcgccgaccaggtgccatcatgacgtgttcacagttggtgaactagggtcgtgacaatcagagacccggtggtctatttcagaggattgagattcccgagtggaagtgggagaggattactatggactttgttactggcctcccgatgactcggaggcagtgtgattcagtttgggtgattgtggataggctgactaagtcagcgcacttcattccagttgctaccacctattcgtcccagagattggctgagatttacatcagggagatagttcgtcttcatggagtgcccgtatctatcatttcggatcgaggcccgcatattacttcacgtttctggacagccttgcatggagagttgggtactcgggttcagatgagcacaacgtttcatccacagacggacggacagtccgagcggacgattcagattcttgaggatatgcttcgagcctgtgtcattgactttggaggctcgtgggaccagtttttgcctttagcagagtttgcctacaacaacagttattagtccagcattcagatggctccttatgaggcgttgtatggtaggcggtgtaggtccccagtaggatggtttgagccgggagaggctcggttattgggagttgatatggttcaggaggccttggataaggtcaagatcattcaggacagacttcgtacagctcagtctaggcagaagagttatgcagaccgcaaggtcagagatgttgcctttatggttggagagcgagtattgctctgtgtatcgcctatgaagggcgtgatgaggtttgggaagaagggcaagctcagccctaggttcattggtccattttagattctagagcgagtgggagaggtggcctatagacttgctttgccacctagcttatcagctgtgcatccagttttccatgtatccatgctccggaagtatcacggcgatccctcgcatgtattagatttcagcactgtccagttggacaaggatctgtcttatgaggaggagccggtagctattctagaccggcaggttcgacagttgaggtcgaagagtttcccttcagtgcgtgttcagtggagaggtcagcctcctgaggcttcgacctgggagtccgagtccgatatgcgtagccgttatccccatctgtttcccgactcaggtacttctttcttttgtccgttcgaggacgaacggttgttttataggtggagattgtgacgacccaatggggtcatcgccataaatgctctttgttccgtgcttcagaggcctcgaaaacctcttgagagattgcctcgatttgcgtgcgcagttcgggcgcgaagccggaaagattttctatgttaaaatatgaactctgtgtttaaaatggtaaaattcaagtataatattgatatagttgactccggtcaatattttgggcaaacgggcccggacccgtgtcgtgtcaatttctaaatatccgtcataaaatttgggactcgtgcatatgcccggaatcgaattccgaggtcccaggcccaagattcggaattttctgtgaaaatagtttttgaaactatcctaagtctttgaaattgaataattgactgttaaatgtcgtatcgggctcgtattttggttccgacgcccggtacaggtcttatatagcgtttaagcgcttcctgtgcaatttggtcgaattcggacgtcgtttgacgtgattcggaccctaatagctaatttgagagcttgaagttaaagtatggattttatggcttaattctatgattttgatgttattttagcgatttgatcgctcgagcgagttcgtaggatgttaatgagttagtatgagtgtttggttgggagccccgagggctcgggagtgatttcggggttggttcggagtagtttttggccttgttgtgttgcagattttctgcaattcctgcccagctcattccttctatgcgatcgcatagagttcctgcgatcgcatagtgtatttctcctcagtaccctctttgttcaatgcgaacgcaatagcatcatgcgatcgcatagggtctccttccagcccttcctttttgttctctgcgatcgcagagtagtcatgcgatcgcgtatctttaacccccttgtgctatgcgatcgcgtccctttcatgcgatcgcgtagtggtaagctttccctcccaggccagacccccttccttcaatgcgatcgcgacttgagttatacgatcgcgtaagcctgtggactgccacctctatgcgatcgcatcaccttcctgcgatcgcatagagcacttttgcccagcgatttaaaatgtccagaacactgttcatttccgcacttcctcccatttttttcatccgagagctattctaaaaatcaccattgacgaacttcaagccattctttctccataaacttttgggtaagtaatcttaacttctttttctcttaatttcttccattaatctttaatttcctagccctaaagcttgaattcaaaatagaaaatgggggaaaagggtagaaactagggcttttgtaattttggggatttcaacctcaatttgaggtcggatttaaaaactaattatatatttgaactcgtggggatatgggggattgggttttggtccgaacctcgagtttcgaccacgtgggcccggggtcggattttggaatttttggaggaaagtttgggatttcatttctaggctttggagttgaattattgagttgttattgatgattttgaatctaatattgcttagatatcgttgtttgggagttggattcgaaagggaaggcggttgtagagctttgaattgctaattcggcattgaggtaagtgtttgttctaactctagttcgagggattaggactaggaagttatttgctatgtgttacatgggtcggtgtataggtttggtgacggttacctatgcacccgagtcaaagcatgaccgtgggtctttacttgaaattgttgaaagctatgttatggagttagctattgaattgatacttgtgaataaattgttggattcaaatgacctaaatggcttaactgaatagttaaagtgaaattctatgtctatttaagttgaattctaaatgattcttgtatcccttgccgggattgattggttatagctgcacccttgccgggttagataaatatatgtgaattgcttgtgttttccccgagatgggacttatatgaaattgaaatgagggcgggtggtacgcctaccacagaatatattgaaatgagggcgggtggtacgcttaccacagaatatatattgaaatgagggcgggtggtacgcctaccacagaatatattataatgggagcgggtggtacgcctaccacaagagatgttgaaatgggagcgggtggtacgcctaccacaagatataatgagtattgggatcgtgtggcacgccgtccacttgtacttgatattttgtttctttgttagttactgattatctgtttagttagtcgcactttaatttattgaactgttcccccttatagcatgctcccctcccatacttgtttaattcctgtattatttttcctgttttcgcatatatatatattctgcacaggttaacgctgtaggtccggtctagcctcgtcacgacctcgtggaccggggttaggccaggcacttaccagcacatggggtcggattgtgctgatactacacttctgtgcccttttgtccacagatccgggagcagcatttggagcgcaccagcactgatagaggagccagccttcagtccagagactgagaggtagttcactggcgtccgtggaccctccagtctctccttatcatttagtttgtttatttgtttcgaacagacagctatgtattttcctttcagacgattggttgtagtgactcttgagaagtctgtacgctgtgacactgtttcttgggtagaagttgtaatagttttgcttccgcattcgcttttatgaaattaattaaagtcttccgcttatcgttatgtctttcagttattaattattatctgttaatggttaagtgtatgttgttcggcttgcctagctccgacagtaggcgccatcacgatacccgttggtggggaaatccgggtcgtgacaatgaacacccctggtactattattaatcatcttgcatatgcagataacattttaattttcactgagggaaacaacaaatccatcaagcttattatgaaacaattgagaggatatgaaaaacttccggctagaaagtgaataatgataaaagttttttcatcacagctcctaacactgttgctactagaatcaataggatgaggaaaacatcaggctttatgaataaagacttcccctttaattatctcggttgtcctatatttcatgggaatttttttttttgctactttgatggaatgattgccaaaattattataaaagattgatggttggcagggtaagatgctttcctacgggggcagaatgactaatcaatagtgtgctccaatctatgcatatctacattttatctgctatgaatcctcccaaaggctccaattcggatttagtcaaattttaatacggatactaaatatcgagcgaaaaccctttaaaaaaaactagcctctatacactttccactagttacatttttagtttgtgttttgtccttgctgcttcaacttgcaataaagtctaggtcgacatgtcttgtcttgtagtctattaacatgtgtggtactgtatgtacttttaattgtttaataagaacaaattaagtaatattaaaatgtccaataagagcaagcctattagttgaaatgtcaaaagttggtatgaaatttagggagttattatgctctcgttatagattttcgttactattttgtaagttaattttttttcaagttctaaaagttgatttatgatagtttttaggtgaaattttttctttcactcacaaaattttaatattttttttaaataaatgcatatctaaacacaacttcaactttcaaatattattttttaacataactttaaaaactctttttacaagttttaattaaatatatgttcaactatgtattcatttctgcttatgttttatcattcattttcataagtgaatttcatacctatcttcatgcaaacacttatactataaaagatatattattcctaaatacaacatgtgatacgagatcattacattataagtgtaacttattattggcaaaattacggttgtttgtctcctagttttgtgtctggtgttaaggtgtcccacatatggtattgggcaagagttggagtcactcggccaccaactatctgcatttgacccattgtttcccgttaaaacaattcgccccaagttgatctatttgtcaagtggccatgtaacgaccttgtttttggttatttggaaaatttctaggaaacccgcaatcgctatccttcatgtgcgcactgagtaattggctcacagtgcaattgctcgcaaatcacacaggagatataaaccgcattaggcacacctggtgcgatgagctttgactaagaaaactaatggtaaggcaaatcaaactcaggtctcccatatagaaaagggaaaccactcatccaaccaatttagtcaatcatgatgggcgtgacttcaaagtaataagtcttttgtgaaggctttccttttgtcatttttctcccttgttcagaacaagttgttctgaacgttgcacgagactccagctgcccaggttcaggatctgaaagagctacagaggcagcacctattgatccaccagctgcccaggttcaggatcagacaccagctgttgagactccagcagcacctgttcaggcatcggctgtgcctattgtgattccgggtcttcaggaggccctggctcagattctatcggtttgcaccggcctagctcaggtcgtatcagcttttacagcagcagccacatctcagatagggggaggacatcagacccctgcagctcgcactccggagcaggttgttcagggcttgcagacacctgaggaagcccttattgctccagttgctccagcagcaccggttgccccagttgcgccagttgcgccagttgcgccagttgcgccagttccacaggttgctccggttcaggaggttatggttccggctatgccagaggacgagcagcgtcgtcttgagaggtacagcagacttttgcctccgactttcagtagggctcagggcgaggatgcccagggatttctcgacaagagtcgacgcatgctccagactgcagggattttggagactagcggagtatcattcactaccttttagtttacgggtgcatcatttacatggtgggagtcatatgagcggcgtaggccggcaggagcagcaccgttatcttggctagagttctccactctcttcttggagaagtgggtaccgcagtcgcagcgagaggagctgcgtaggcagtttgagtatcttcggcagggtgatatgacagtgtcacagtatgagatgaggttttttgagttggctcgtcatgctccgtggatggtcccgactgatcgggagaggataaggagatttgtggacgggcttatctatcctgttcgtattttaatgtccagagagagggttttgacccattcctttgaggatactgtcgacattgctagggacattgagacagatcgccgtttggagagagaggagagagaggccaagaggtctcgaggatcaggtagtttcagcagtgccccatgtaggggtcagtttcagcagggtagaggtcgccctttcaggcagcagcagtcggcccgtcccgagtatcgcggggcgtattcaggccgtggtcatcagggttcacagcagggccagtcttcactgagtgcactccctgtcgacgcccccttttttcaactaaaaagagaagctgaaatcgggtttacgacattatgggcaaaacaactctcattcccgttaaggaattgggttatggaattagaagattcgccacctaatgattatagtgcattaggacacttaaaaaataaggagtgcttttagatgaaaaccagagttcgggtaagggcttgagattatctcgaggggaaggtgttaggcacccctcaagatccacaagtgtggttcccggccatgctaattgtgactttagaaagagatgaagcaagtaaacaaattaagtatacatgtatatcattcacatgatttgaaagctttaaagagaagttaggacatgagttggaaatagaagaggactagttttgaaaagcactaagagagaaagcatttaaataaagcacataaaagaaaaaatgggtcctaggtttgactataatatggatcatttggtgcaatacccagcaatcattctcacacgagatattaacgcaccgtcatcatctccatattctaccctcccaccccgttaaggtattaaagcgcgttggtatcgtttacttattgcatgttaatacccgtcccaacctgttgctccctttccgagacgcgtggtaaattgttattgttgttcccttgccgggacttagtattgttgttgtattcccttgccgattcccttgccgattcccttgccgggacttcttgtgttaattgttactcccccgccccgattgtggttgttgtttgggtgagttcgtggtatgaatttagaaggatcgggttgcacggcataatggtattaaataatgaggatcgggttgcatgccgcaacagtgttaagtgagaatggaatgggatgcacgccgcatcgactctgaatatagttggaacgggttgcacgccgcaacgaagtgtggattaagtgtgctgccagcatatgtggagttttctcgtatttccttttctgttgttatggaatagtgttaaatctttatccgatgatcgtatacctgatttgtcacaccccatagcatgctccctttcctcttaactggttatattacgtatattttcggttattgtatatatatctgcacaggttatttgtggtatgtcctgtctagcctcgtcactacttcgccggggttaggccaggcacttaccagcatatggggtcggttgtgctgatgctacactctgtgcatttttgtgcacagatcagggagcagctttcgtaccgcagcactaggatttctgggagctatcttcagtccagggactctcgaggtagcctagctggcattcgcgggccgaagtcccttctatgtttagtttgtttattttgtatcggacaaacatttatgtatttcctttcagacttgtatttagcattctgtaatagtccatgagtagtgacaccagactctgggtaaaagtgtactgttggaacttccgcatttgttcctctgtattttagttttaaaaacttccgcttattttacctgcttcgttttatttatgttatcgcaagtgctagttaagaatgtttgattgttggcttgcctacctcctaatagtaggcgccatcacgatttccgatgatggaaaatccgaatcgtgacaattagatccaaagtatatcgagtgataaagacgttgttcaattatgaatagtacagaagcaaatttaaacctatttttataatgaatatcgttaatcggtaacttatgcaatgctcttttacagtcagaaatagcgagcaatttcgttaacaatgtacaagactattcaatcaacattcaacattaatgtatataaattaatatttgacctatatattattctacataacctaatttaataaaaatcttgcttccgccactaacaaacacgatgttctacataaacttttgatgcaataccgaggtgttgggtctaacactaggcctttagattatactccttatttttcaatttatgcgaacgtatatgactgagcatgatatttaagaaaaaaaacttttgaatttgtagtataaattgagatacatatattttgtctaactatgaattattgtataaaagtaaattatttttaaatataaaaatgaatcattatttttagtacgagttaaaaaggaaatagatttacgtaaattgaaatagaggagtatatgacaatacttttccggatttagttaaattcaatacgaatactaaatatcaagtgaaaacctttttaaaaaaaaaaaaggactagcctctattcattttccactagttaaatttttagtttgtgttttgttttgttttgtccttcctgttgctacttgcagtaaagtctaggtcgacatgtcttggcttgtagtctattaacattttggtactgtatgtacttttaattcgtgaaaaaaaaaatgtttgttaagtaatattaaagtgtccaataagagcaagcctattagttgaaatgtcaaaaggttggtatcaaatttagttagcaagcctattagttatttatgctcccgtttggccatagattgtggttattattttttaagtttaattttttttcaagttcccaaaaattgatttatgataatttgtgggtaaaatttttctttcactcacaaaattttagttttttttacaaataaaatatatgtccagacacaacttcaacttctaaatattatttttcaacacaaatttaaaaactcttttttcaagttttagttaaatatatattaaactatgtattcatttctgcttatgttttatcgtacattttcataagtgaatttcatactcatcttcatgcaaacacttatactataaaagatatattattcctaaatacaacatgtgatatgagatcattacattgtaagtgtaccttattattggtaatgtttggacttcacccaaaaataattaaggaagtaatgatatgcaataaataaataaagttgaaaaaattaaacttgactcgagacacattaggttatttgtctccttatatggtcataaaatctcgagtaacccatatttcaaggctagcaattttttagagctgaattaagtttaaaattcatttctttcgtgtgagcgtgcggggtgttaagcaggggctgaggaagagcattagtcgtgggctcagatgaactaagtagttgttatttaaaccttgtatatgtattagaaaatacataaaatatgtataaatatttaattacgaatctaataactaagataaactatgggttagtgataaatcaagaatctataaattttaattcctagttccgcctctggtgttaagctgtccaactgtaaaaattgcactagggcgcccccttttaacctatagccgctttatctttttgcttgcatccgtacccactttttcacataacttcaacccacggggctgaagtgtttattttataactggacaacttaagctgcaaacggcctaagtgtttattttataactggacaacttaaacctaacaccctaagtgtttattttataactggacaacttaagcctaactacctaagtgtttattttataactggacaacttaagcctaacagcctaagtgtttattttataactggacaacttaagcctaacagcctaagtgtttattttataactggacaacttaattagcttaacagcctaagtgtttattttataactggccagttaaggaagaacacttctgcctaacagctgaagtatgttgaaaaagcgggtatgtttacaaacaaaaagacaaagcgggcacaagttaaaatgtggcacaaaaaacggatacggctgcaaatcccccacatttgttgagggatgggttgttatatggtcttgggcaagagttggaatcacccgcccaccaacatttggcccattgtttcccgttaaaacaattcgcccaaagttgatctatttggcaagtggccatgtgatgaactttttttttttttttttttttggaaaatttctaggaaaccggcagccgtacgaaacccgcagtccctagtaccctttgggtgcgcactggataactagtttactgtgcaattgcccttaaattacataggagatataaatcgcattagacacgtccggtgtgacaagctctgactgagaagattgctggtgaggggaatcgatctcaaatctcccacgtgagaaatcaccacccaaccaactaaaaccaaggcgggcttgacttcaaagtaagtcttttgtgaaggctttctttttgtcatttttctcccttgttcagaacaagttgttctgacagttgcacgagacattattaagttctataaataggggagaaacattatttcccttttcacatcaaaacttgaaactccaaatagctcatcaaaatgttttccaaaactagcctttttctttgcctttctttggctattttactaatagtaatatcctcacaagctgatgcggagacgtctaaggcgcctgctacaataccccaaggtttatttacttcttcaatctattactagtagttattcacttttaacattttgagttagcaaaaggattttataaaatgtttaaatattcatctaacatttttctttaaaatttgtgattttaaaatatgttatgatatcctataaagaagtattattaataaaaatttggaaattccggattaaaaaattgttaaatgttggtggcattcttttttaaacggatttttttttaaaaaaaaaagtaaaaggcatagattaaaacagcaggagtaaatgtttacataatcatttagcattttactgacggtttaatggacatttttaaacattctacatccaaagtatttagtgatcttatgatatatatatatcgcaacaccgcagaagtttcttctttttatctttattgaattcggtaatataatagtttaaactctattgctagagcaaggactcttcaatttaattacttataggtcaacattcattcatacatgcgggatgcatgactatctactgaccttctaccctaattctcgacctccacattcttttatcaagagtcatgttctcgataattatagaagccccatttcctgccaactgtgtgatcatttaatttaaaacttaagttgttagatgaggaacacgttcatcctagtttatttatgtcggccgcgctgagaattaatactatcacatcttaatttcctcctttgttagttaacctataactaatacattactctacataaccaaatttggtgcagcaatgaagatgggtgcaggaatccaaggcgtcggcaaaggggaaggcaaaggcgtcggcaaagccgttggcaaagccgtcggcaaaatcatcggcaaggcttgtaaattttgctcatgtgaaaacaagatttgcagcaaatgtcctaaatgtgatcgcccaactcccgtcgtcaatgcttgtaaaatttgctcatgtaaatacaagatttgcagcaaatgtcctaactgcccaactcaagtcggcaaagcttgtaaaaaatgcgcatgtaaatacaatatttgcagcatatgtcctcaatgcaaaaactaaagttaggcctcagagaatatatacttgtgctggtgtgagtttagttttgagaataaagggaaagctatgaatagcctaattatataattctattcactttattttgttagtagttcttattgttacaacttgcaacaagtctttgggtcaaaatgtacctcttgtcttgtggtctttcaaccgtatggtattgtattcctgtatttttctttagccacttgatatcttaaaccaaatccgattaaatcttatttgcgttgcatatgttagtcatctagacttctctattacagctgtcacgaccctagttcaccaattgtgaacatgtcatgacgacacctggtctgcgagaccgggtaagcctaacacattgcagaattcaacaaccattatgaaaagtaacagcaaaattactgaaaaacaagacaaatgtatactttgccgcgtggcacatacactttactgaaaatatctggaacaactcccagaacccagaaactcacgggcaacacaggctaagaattttacatgaactgctctaaccatccggagtagtctagtacaaagggaagtggaatgacagctagctaactaaggatagagtgagtgggagactagtaggatctgcggacgtcgcagatgaatacctcaagcctccgtaaagctccctgcagctactgataatacgcctgcgtagaggtacctggatctgcacatggaaaacatgagcagaagaggcgtgagtacaccacagcggtactcagtatgtgccaagcctaacctcggttgagtagtgacgaggaaggtcgaggccctaccgagataaatataataaagaggagaatatgcaatatatagatgatcagttaaataataaggaacgacagcagtttaaagagaaatttcgaataacccacagtcaaagaagacaaagaatacacacagcaaagcaataatcagaaccaagtactcagaggatctcccaggataccgtcctgtagttctttctcaactgtctcagtggggatctcccgggataccgacccgtagtccatcatatgatctgtcatatccgaaggatctcccgggataccgacccgtagtccaacaaatctataccaagtactgggggaatctaccggctgcattgccgtagttccatacatttgtgcgggggagctcccggaatcccacatccatagtcccaaaataaacaaggaaggggaaactcccggaatcccaaatccgtagtcccaaaataaatgcacaaacacaacaaaggatgtacatgaattaaattacaaaacaccatcagttaaggaatctagcctaacatgctgcacatagagcaatacgagcaaaataagcatttaacgatcaattctatctaatcatgctttcctaactatcacaggttgaactgacattttataaaagtcaaataagcggagaaacacggtctaagtaattcaagtaaggtggaattcaacaattagcacaagtgcacgctcgtcacctcgatcacagagcatttaaatcaacaaataagagaatcctaagggaaaagtcccccacacaaggttagacaagccacttacctcgaaccggccggcacaaaaatcactacaaagcaatgtccttgccacgagtatccaacttcgaatggcccgaatatattcaaaccaattacataatataaataacatcgcaagtaactaattacactaataagattaaagcaacgacgcgaaaataggtaaaataaccaaaatgcccctcaggccaatgtctcggaatcagataatttttacattttcagaaacctcgttctctcactagtctaaccatataaagttctcccaaatcggaggtcaaatgcccccttcaaatcatcaaggttaggtctaagaactttaccccaattttcaaccaaaatcagaaattaaagctttaattcgagtttagattagtgggtaataatcataagggagtaagaaatcgttacccaatagttgcctctgaaaaaccctcgaaaaatctcccaaaaccgagctccctaacttgagtttttgtaaaaatggaagaaggttcgtgtttgaaatattatatactgtttcagtgaattgctctatgcgatcacggaagaactgatgcgatcgcatagagtgaaaagtgatagcccaagatttggtctacgcgaaagcaacgaaaggaatgcgatcgcagaagaaaaggagtctgagcctatgcggtcgcaatggggaatatgtgatcgcatagaaaaagttggtccagaggcccaggctctatgttgctctatgcgaacgcggcaacagaggtgcaattgcactgaaggaagggacaatgctatgcgatcgcagagtgatgtctgcgatcgcattgaaggaaattttggccagctcaagggactctatgcgatcgcggaggactctatgtgatcgcataaaaggattttctgcaacactaacagcagaatttaagttccggaatggctccgttgagcatccgaaacacacccgaggcccctgggacctcaaccaaacctaggaacataacccataacatcattcaaacttgtaccaatccttaaaccacctaaaacaatgccggaaacacgaattaatcaatgatttgaacttagaaattccaaaacttaaccaaactcgctttcgatcaaaaacctaaccaacacacgtctgattgacctgaaattttgcacgcacgtcccaaatgacatgacggtgctacagaagctttcggaatcccgttccgaccctcggatcaaatattcactatcggaccggaaacttcaaaattctaactttcggcaattctaaccaaaatgagctacggacccccaaaatacattccggacacgctcccaaccccgaaatcacctaatggagctaacggaaccatcagatttccattccgaggtcgtcttgacactgttccgactacggaccattttccaacacttaaactctcaaatagggactatttgtcccaaaatactccggattcaaataacgaacatcccggcaaacaaaaataacataattaaacttagggaaagcagttaacggggaaacggggcgcaaattctaaaaacgaccgaccgggtcgttacatcctcccacacttaaacattcgttcttcctcgaacgagcatagagaacatacctgaagcagcaaaaagatgagggtaacggctgcgcatatcccgctcggtctcccaagtcgcctcctcgatcggctggccccgccacagaaccttcactgaggctatctccttagacctgagctttcgaacctgcctgtccaatattgccacaggctcatcaacacaggacaagtccttgtccaactggattgaattgaactccaatacatgggacggatcaccgtgatacctccgaagcatcgaaacatgaaataccggatgaactccggccaaaccgggaggcaaggcaagctcataagcaaccttcccaatttgcctcaaaatctcaaacggaccaataaaccccggacgcaactttcctttcttcccaaacctcatgacgcctttcataggcgagacccggagcagaacccgctccccaaccataaaagaaacatcacgaacctttcggtccgcatatctcttctgtctggattgggctgtacggagtcggtcctgaatcaccttaaccttttccaccgcatcctgcaccaaatccgtacccaatacccattagtcatttagacttctctattacagcatccttatataacaccctttcattataaaagccaaatttttctttcctacagtggattatgccatattcaatatttacagcaaagattgcatataggtaattatttattactattccgtaatcatatattagtctcatatatactattccgcaaatttaaaccctttataatgaatattgttaatctgtaacttatgccatattcaatatttacagcaaagattgcatataggtaattatttattattattccgtaatcatatattagtctcatagacatactattccgcaaatttaaaccctttataatgaatattgttaatctgtaacttatgccatgctctttaagtctcagatctatctacgctacagcaacaacaacctagtataatatcactagtaaggtctgaggagggtagagtgtacgccgacctagaggatgtttccggtagaccctcggctcgaaaaagataaaagaaggacaacaacaaccatatcaatcggaaaaccagagcaaaaatacaaaaccaaccgtaagtattgtaattagaaagccgaaacgaaagcaacaagtaataacagaagtcaaggggtatgacaatacacagacatgacaacactcagctacctatcttaaccctttaccattattctcaacctccataccttcctatccatggtcatgtcctcagtaagctggaacaacgccatatcctgcctaatcacctctccccaatactttttcagcctgcctctacctctccccaggccctccagggccaacctcttgcacctcctcaccggagcatctgtgtctctccttatcacatgcccgaaccatttaagtttcgcctcccgcatcttttcctccacaggggccacacccatcttgtcccgaataactccgctagtagggtaaaaaaacaagggagagaaatgaaatgcaaagatgagagaaagcaatggcaaagccagcaatttcattaagaatgatcaggactgttccacattcaatataatgtatacaaagtaatatttgacctatatacaccgtacaattctcaagcaaaaggtatttaactggcctcccttgacctatgtagctccaccattgcaaggaattattagtgtatttaaaaaggttttcaaatggctacaagaaggatccgttagccaagaaggatcaacagtaatgacatttcgcatgtactgacgatccgttgaaacaagagaatggtatactatcaaatttgagagaactcattataaacttaagatgtaacagaacataataacacttcaacttatctagttttattttttcctattttatcctaaagtaaccagggacaatatccaaatatgctataataggatgcaacaatttggaacatccactgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaggcaccacctgccccacagcctgcccagccagctagaggcgggggcagaggtcatagaggtggaggcagaggccttagaggtggagctcagacagctcgtggtagaggtcaggcagttgtagatcagtctagagatgtcatacagggaggtggggcccagccccgttgctatgctatgccggccagacctgaggccgagtcatctgatgccgtgattacaggtactattctggtctgtgatagagatgcctcagtattatttgatcctggatccacgtattcctatgtgtcatcatattttgcgccttgtgcggttatgcctagtgaggccttgagtattcctgtccatgtgtccactccagtgggagactctatagtagtggaccgggttcatcgctcgtgtgttgtggtattcaggggtcttgagacccgtgttgacatattgttgctggatatggtggattttgacgttattcttgggatggattggttatctccttatcatgcgatcttggattgtcatgccaagaccgtgaccttggcgttgccggatatgccctgattagagtggagagggacccccggtcgtaccactcgtagtgttatttcttatatgaaggctcgacgtatggtcgagaaggggtgcttagcttatctggcttatgttcgcgattccagcgctgaggtcccgtctattgattctgtccccattgttcgggagttccttgaggtgttcccttctgatttgccgggcatgccgcccgacagggacatcgatttctgtattgatttggcgccgggcacccagcccatttctattcctccttatcgcatggcgccgccagagttgaaagaattgaaagaccagcttcaggatttgcttgagaagggtttcattaggcccagcgtgtcgccttggggtgctccagtcctttttgtgaagaagaacgatggttctatgaggatgtgtattgattaccggcagctgaataaggtaacgatcaagaacaagtatccactgccgaggattgatgacttatttgatcagcttcagggttcgaaggtattctccaagattgatttgagatccggttatcatcagttgaggattagggcgtctgatgtccctaagactgtttttcgtactcgctatggccactacgagttcctggttatgtcatttgggctgactaatgccccagctgcgtttatggagttgatgaacagagtattcaggcctttcttggacttatttgtgatagtcttcattgacgacattcttatatactcccgcagtcaggaggagcacgagcagcacctcagagtggttcttcagactctgaaggatagtcagttgtatgtcaagttttctaagtgcgagttttggttgagtttagtggcgttcttgggtcatgttgtttcagcagagggtattcaggtagacccgaagaagatagaggcagtcaagaactggcctcgaccagcttcagctacagagattcggagcttcctgggattagctggttattacagacggtttgtagaggggttttcatccattgcatcccctatgaccaggttgacccagaagggtgccttattcaggtggtccgacgagtgtgaggcgagctttcagaagctcaagacagcattgaccacggcaccggtattggtattgcctacaggttcaggatcgtacacggtctattgtgatgcttctcgtgttgggcttggtgcagttttgatgcagaatggtaaggttatagcctatgcttcgaggcagttgaagatccacgagaagaattatccagttcacgatctcgagttagcagcgattgttcatgccttaaagatttggaggcattatttatatggtgtgacgtgtgaggtttacactgatcacaagagcctccagtacttgttcaagcagaaggagttgaatatgaggcagaggagatggttagagttgttgaaggactatgatgttacgatcctatatcatccgggtaaggccaatgtggtggccgatgctttgagtagaaagtcagctagtatgggtagccttgcctttgttccagttggtcagagatcacttgccatagatgttcgggccttggccaatcgttttgttagattggatgtttcggagcccagcagggttttggcttgtacggttgcccgcttttctctttttgagcgtattcgcgagcttcagtttcatgatccccatttatgtgtcctgagagacacggttcagcgaggaggtgctaaggaagtgaacctgggagatgatggtgtattgagattgcaggggcgagtttgtgtgcccaatgttgatggaattcgtgatttgatcttagcggaggcccacagttctcggtattctattcacccgggcgccgcgaagatgtatcaggacttgagacagcattattggtggcgtaggatgaagagagatatagttgcttatgtggcacggtgcttgaactgtcagcaggtgaagtacgagcatcagagacctggtggtctatttcagaggattgagcttcccgagtggaagtgggagaggatcactatggatttcgttactggcctcacgatgactcggaggcagtgtgattcagtttgggtgattgtggataggctgactaagtcagcgcacttcattccagttgctaccacctattcgtcccagagattggctgagatttacatcagagagatagttcgtcttcatggagtgcccgtgtctattatttcggaccgaggtccgcagtttacttcacgtttctggacagccttgcatggagagttgggtactcgggttcaaatgagcacagcatttcatccacagacggacggacagtccgagcggacgattcagattcttgaggatatgcttcgagcctgtgtcattgactttggaggctcgtgggaccagtttttgcctttagcagagtttgcctacaacaacagttatcagtccagcattcagatggctccttatgaggcgttgtatggtaggccgtgcaggtccccagtcggttggtttgagccgggagaggctcggttattgggtgttgatatggttcaggaggccttggataaggtcaagattattcaggacaggcttcgtacagctcagtctaggcagaagagttatgcagaccgcaaggtcagagatgttgccttcacggttggagagcgagtattgctccgtgtgtcgcctatgaagggcgtgatgaggttcggaaagaaggggaagctcagccctaggttcattggtccatttgagattctagagcgagtgggagaggtggcctatagacttgctttgccacctagcttatcagctgttcatccagttttccatgtatccatgctccggaagtatcacggcgatccctcgcatgttttagatttcagcactgtccaattggacaaggatctgtcttatgaggaggagccggtggctattctagaccggcaggttcgacggttgaggtcgaagagttttccttcagtgcgtgttcagtggagaggtcagcctcctgaggcttcgacctgggagtccgagtccgatatgcggagccgttatccccatctttttcccgactcaggtacttctttcttttgtccgttcgaggacgaacggttgttttagaggtggagattgtgacgacccaatggggtcatcaccataaatgctccttgttccgagcttctgaggccgcgaaaacctcttgagaggttgcctcgatatgcgtgcgcaatccgggcgtgaagccggaaagattttctatgttgaagaatgaattctgtgttaaaattgataaatttcaagtataatgatgatatagttgactccggtcaacattttgggcaaacgggttcggacccgtgtcgtatcaatttctaaatatccgtcataaaatttgggactcgtgcatatgcccggaatcgaattccgaggtcccaggcccaagatacggaattttctgtgaaaatagtttctgaaaatatcttaagtctttgaaaatgaagaattaatttttaaatgtcgtatcgggctcgtattttcgttccgacgcccgatacaggtcttatatagcgtttaagtgcttcctgtgtaatttggtcgaattcggacgtcgtttgacgtgattcggaccctaatagctaatttgagaacttgaagtctaaagttgaaaatcatggattttatggtttgattctatgtttttgatgttgttttagcgatttgatcgctcgagcgagtttgtagaaggttaatgagttagtatgagtgtttggttgggagccccgagggctcgggagtgtttccgggggtggttcggagggtattttggttgaaaaatctggtgttttggttcagttgttgcagaccctgggaatgctctatgcgatcgcattcaagcccccgcgatcgcatagagcagtttgtcagtcccatctttttgctctctgcgatcgcagacagcctcctgcgatcgcgtatcttggccatgttattcaatgcgatcgcgtcccatccatgcgatcgcgtagtgcagagtagccccgcccaggtcagccctcctttcctctctgcgatcgcgtgcctacctatgcgatcgcgtaagccttggtcctgctatctctatgcgatcgcatccgtgttcctgcgatcgcatagagcatttttccagcgattttcttttaattcaaaacagtgtgtccgcgactctaaccccatttttcatccgagagctcaaccaaaaacctccattggcgaaaatccaagctcttaatcttcataaacctttgggtaagtcaatcctaactcgattccttcatcatttcttctccaatcattgaattcccactctttaaatcatgaatttaagctagaattaagggtttttggggttagctagggcttatgggattttgagcttttcaacctcgatttgaggtcgaatttaaattctaattatatatttgaactcgtggggatatgggggattgggttttggtccgaacctcgagtttcgaccacgtgggcccggggtcggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggattttggaatttttggaggaaagtttgggatttcatttctaggctttggagttgaattattgagttgttattgatgattttgaatctaatattgcttagatatcgttgtttgggagttggattcgaaagggaaggcggttgtagagctttaaattgctagttcggcattgaggtaagtgtttgttctaactctagttcgagggattaggattaggaagttatttgctatgtgttacatgggtcggtgtataggtttggtgacggttacctatgcacccgagtcaaagcatgaccgtgggtctttacttgaagttgttgaaagctatgttgtggattttagctattgaattgatccttgaaagtaatgtgttggatttcatatgacttaaatggcttaattgaaaacttaaagtgaatttccatgtctagtaaggttgaattctatatgtctcttgtgttccttgcggggatttattggatataactgtacccttgccgggttagacaaatatgtgtaaattgttgtgttctccctgagataggacttgtgtataaatgaattgagctgaaaaacatgataatatatgggcgggtggtacgcctaccacaagatatgataatatgagggcgggtggtacgcctaccacaggatatgataatatgagggcgggtggtacgcctaccacaagatatgatacaatgagggcgggtggtacgcctaccacaggatatgatgcaatgagggtgggtggtacgcctaccacgagatatacttctacttgatggtttatcgttattgattcctgaatatttgtttatttggttgtactttaaaatattaaattgttccgcttaattttatgtctttaattataaattgttagttgtaattggttatgtgaatactggatcggcttgcctagctccgatagtaggcgccatcacgatacccgttggtgggaaaatccgggtcgtgacaagttggtatcagagcactaggttacttaagtctcacagcttacggacaaactcggtagagtctgagggagcggtacggagacgtctgtacttgttccccagaagctacagagtttggaaaatctcactttattcattcttgtcgtgcgattctgtttctcaatattgattgtctctctattctgtttcttcgcagatggcgagaactcgagcttcctcttcttctgatcagcaggccgatgccccagcagcagttccagttaggggcagaggacgaggccgcgctagaggccgtggcaggggcagagctcagccccgagccgcagtgccagaggtggagccccagattgagactgaggggactccagccccaactattcctatggtcgtcccgggtcttcaggaggccctagctcagatcatgtcaacgtgctctagtctagcacaggtggtctcagccaccgccgcagttgccacttctcagactgggggaggtactcagaccccagttatgcatacacccgagccagtggtgcagggactccagactccagaggcaccacctgtacagcaggttgccccagctccttcagtcgtgccagttcaggcagttgttgcgggccagactagtgatggtgcggcgatgtccgtggatactttgtggaggcttgaccgcttttccagattatttactcttaccttcagtggtgcaccttctgaggatgctcagaactatctatttacttgtcatgagactttgaggactatgggtattgtggagactaatggagttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctctctttgaagtcatcacaattttttttcccacaagtgcaataatcaagaaaatttaattatttcaactatatcaattatttaacagatttgtaaaagaaaacttaatatcaattttaaccgactaaatctcttgatattttaggtaaagtttcgagtactccaatacgttagttaagcctctttatacagaggaaaaaaaaagatcgaaatttaggtataagttgatatggtaattaattgtatgggctacaattaatgagtatacatttatagattattaaacacaacgtcctaagtattttaggtcaaaatttccataactttgcaactcctttaaggtctaggagatttttcttttaagttgctgagttagttgcatgattccgttcagtcattttttttgagggttccccctttgttcatattccaattcgccttcacgtgtaggtacttcatcgttcctcaaatcttctccttttaaagtatatctaatttgttttgattttatttttgtctttttgcgttttattttagatctgtcgttgataatttattgtgtcttgaatacaactatttctttaatgtaataatttttttgcatcgtcaattgctattaaacttaattcattctaattcaatttcatatatactattttggcagtttaccatttaaatgtttgttgcatcatcaattacctttatacttaattctttcttattttacctattaaaatgtgctcttttgtgcataacgcataatacacgtgcaacgcacgtacactaattctagttatattaaaagcacgaaggcccctagtgaactgtcgttcgtcttttttaccctttaaaaataaagtttacattggataaaatagtaatttagttattttcctaatatatagaaatactcatttaattattttcctaatatgcaagaatactcatttaattattttcttaatatttaggactacaaaatcaactaaattttatatatcacattcttccttatttggattacatagaaaaatttaatatgtcgaacttcaaaaatattaaaattttattttatataattttttacaattaaattatatataaatggcaacaaaaagaaagaattaaaaatgctaaccaaataggacgtaaccacttggtatttagaagtttacccctttggatagataccaagaattcaatcaaaaaaagaaagaggacgtatggtgttcttgaaagatgacggagtaacttttttatgttttgatttaggtgaaactcttttatatactaaaatactttaaaatatacaaaactatttcccacccatttgattttcttacaatttgacaaaagaatttttattcaataaaaaatattataatcaaatatttaaaatttgttgtgagctaatattgagaatttaaatcaataaaatataatttatattgtttattgctgaaaataaataattaagtatttggaatagctaattagcaaaaaaatttaatttcattatcttttaaattcatcatacaagtaaaactatcttcaggttgacaaaaatcttggcttaaatatatatgtttcaataaaaaagaccaccgatgatgaaaaaaattagaaaataaagtcgaatcggttataatattaatattaaaaactaacttggttaaaagtcaaaatagaagaaataagaatgaaacaataagtattcaaaataagttgacatttactattatttttatttttcatctattctaataaatgaccctctataattttttctgtaacaatccggcctgttgttttgagagttatagccctatttcccccatctatgcttctttatatattgttcagctctgttgagttgtatcgagttggtaagtttgggttcggagtagtttttggagtgaaatgaatacttagtctcttagttagagagctaagttagaaaagtcaatttgaagttgacttatgagtaaacgaattcggatttggatttttatgattcgattagcttcgttgggtgattttaaacttaggagtatgtccagaatgtaatttggaggtccgtggtagaattaggcttaaattggcaaaagttggaagtttagaagttcttaggcttgaattcgaggttgatttggtcttttggtgttgttttgggcgttctagaggctcgactaagttcggtagtgatatatggcttgttaaaattattggttgaggtcacgagggcctcgggtgagtttcatataggtttgggttgtgtaacgctcgtaattcttatgtttcaacgtcgtttcttcaagtataaataatatcatattgaacaaatgagctccaatttcttttttgattgaatcattagatgcgtatcgtaattacggacccgtagcaaaaagaatcgtcgaatttggacatcgtatgaggattttagggtcattttactaagaattaggttgtcagatttttcagattaattacgaaattgccactagcagcgtatttaaaaacctgcactatttgcaaatattaaaacctacatatctcattcattataaggtcaaattgagtgattcaaaagcctattttgactagaatttcacaaggaatccattagagccataaaacacgagtttcgagattttttgacacgagaaacgaggcagaatagctggcagaaaattttataaaataagggtttgttcactcgatcatattttgagttggggagctcggattggggcgattttggaggcgattttcaccatatggattggggtaagtgttctctactcatttttggttatatttcatgaatccatcatcgtttttaggatttgattgatgattttaaggtgaaattgagggagttagggcttgagttttggagagttttaggtaaggatttgagggaccaaacggagttcgattttgataaattttatatggatagactcaggagagaacgaggtttatgattctgtcatttttgactgatttcgagatgttggcccggggggcggattttgaccaatttcgaatttttggcatattttatagtttttattgtggaatttgattccttagcctatgttgatggtattaatctgattatggttagattcgaaacttttagagaccgagcccagagacgagggcatcccggagtaggattttatgcggttgaggtaagtaacagttttaactctggctttgagggtataaacctagagaatttgatatcgtgtgactgtttagaggtgatacccacgctaggtgacgggcgtgtgggtgtatacctctagggatggagacttggtccgtcccgtgaggcctcatggccatcatctgtgtttacgtagttacttgttgttgaacttgtctaccttcatgttagagattatgcttaggctttattcatgctcacattatttgtacttagtcatataaattattgtacatgtttacctcaatctctattatttgctaatatattgtgatacttgatgtgggatgtgtccccttatttgttgatgatggtgaggctagtgaggtacatgattgagtaaggccgagggcctggttgtgaggatattaataccatagcgcgtgagttgtccgcgtagcacgtgagttgaccgtgcgggtccaggtatttatgccatagcgcgtgagttgtccgcgtagcacgtgagttgaccgtgcggatccaggtattgatatgatggcacgtgagttgtccgtgcttagcgcttgggctttgggagcccctccggagtctgtacacacccccagtgagcgcagagtgttgagcgtattgagtgttgagtgttgagtgttgagtgctgagtgagggagtgacattgctgtgaagttgcatttactcttgttgttgctgcatttatctgttaacttctttgtggtatttgttgattttatggaatttacctgtttattcatgtttattgcaaattatgaaaataataattggattgtttttcttagctcgtcactactgctcagttccttagttatttctgttactactgaggtggtagtactcatagtacaccctgcactttatgtgcagatccaggtgagttaaagcgcggtgatcgttgagttcaggctggctatctgtggagattgcaaggtagttgctagtgtccgcaggaccttgttactcctcttgtcatttcgtcttttggacagttagacagttcatatatcttagtttatagttttagacgctcatgacttagtgacaccccgatgtttgggactaacttccgtatttttatatattatatttagagtgatttagtttatgagaaaattttaaatgtttaaatattttattaatttcttaaaatcgggttagtagtaatattttgggaagtaggcttgccttgtaacacgataggcgccatcacggccatggttagaattttgggtcgtgacattttctgtacgtaataagttattggttgtaaaatacacattcagtattagtcagttttagaccttacattttttcttaattattcctagaagctatatgacctagccgttcattccaatagctctaaaagaaagatacaatatttttaattaatgctaatttaatgactgttagaagaattataataaaaatatataacgatttcgatcatgttagatttaatattatgacacaaaaaatgactacaatttttgtaagcttaacccaaaggatacgcccttcaaattaatataaaatatatgtgctcaagttttttacgtgtgaagcagtttcttctaaaaactatatgacgaccctctttatttcaaatctctacaaaaatataattatttttactgatggcctcttgaagaatcataataaaaatatataataaatatcggaatttaattatcaataagcagatatgttgtaatgacccgacccgtcatttcttatatttcagcacgttatccccgtcatatgtttccccgtgtgttgttatgtgtattcggggacttgggaatggtttgaatgggaatcggataggaatgggttaaagagtccctttaagaggaacttgagttggaaaggtcaacccaacgttgacctatgggttagagggctcggaacggatttccgatagctcgactagtttcgggggttgatttgtgacttagtagtgaaagcggaaatgaattcggagttccggagtgaaagttagctaggtttggcgaagttggaaattcggaagaatccggtcgataggtgagaaattgatccgagcgtcggaataggatttcgaaagttgcattagctccgttaggtgattttggatgtgtctgcaaattttcaggtcatttggacgtcgtttggttggtttcggcatcggatatgaattttgaaagtttaagtctaagcttgaattgaattctatgattttgatgatttttggtgttaaaggtagcgttcttatgattcgaacaagtttgaatgaagtattaggttgagtttgtgcctttggttgaggtcccgggggcctcggggtgatttcggatggtttggcggattgattttggaccttgtggtgctgcagaaatgcagtcagctgttgcagaggagttatctctatgcgatcgcagggtccttatgcgatcgcatagaaggaattatggggggtggtcagttgagctatgcgaacgcacagcttgggtgcgaacgcattgaagaaacctggagggccatggggatgtgctatgcgaacgcactggccaagtgcgaacggagagaggacctggggaaggctgaggagaagtactatgcgatcgcacagtgaggccgcgatcgcatagagataggacgcctgggcagattatgttttaagtcttgttttgttcgcgagccatgggctatttccaccatttttaagaaaccttgagagctcattgacggaatttgaaggggatttcatcgggagatcattggaggtaagtctcgtggtcataatacgcctttttattgaagaattaagcttaaaatctctaaaacttggtgaaattaatgaagaactagggcttgagttttggtactttaaatgatgatttggaggagcaattggactccgattttgataaattttatatgtatggactcgtggcgagacgagggtcattttggtttaaaattttctggttttcgagacgtgggcccggggctcgggttttgcgattttcgcaaattgtgatgtttttcgagttctttcaattgggttatgacccattagccttgtgtaacatattcgtcgtggttttggccagattcgacgctcgtagaggcggatttgaggcaaaagggcatttcgagctagtctacggccggctagaggtgagtaatgtcagcaaatgctgttctgagggtttggaaccccgaactttcacatcgtaacgctatattgaggcgtgacatgcactccatgataagtgcggggtcggatattgttggggattgagacttggtccatcccgagtgactcttatactatatgggcgtatgatacgcatactgtgatgattgttatgaggctttatgccgtgtttggggcctagcgccgacctgttaaatccttcgggagttatcatttactgtttagcatgacatgcatttcgtatactatcagtccatggtttttaaaacactgttctacaaacccagccgcattttctaagtttcaaaactcatatgtcatcttttaaatacatatcggctgagggtaactattctttaggctacatgtccgcggtgagccccagtggggtagatacggtgtggcagggccggcgacgccgtgggccccagtggggtagatccgggtcgttataaatggtaacatggacacatgtgtgatatgatcggtcatgtaacatggactggcctggtattgatttcgccactcgatggctggttattgcgcttaggctgtaggagcccctccggagtctgtacacacccccagtgagcgtcgtcgacgataaacgatatgggtggctcgggctgcacgccgcagtgggtactggattgtaccatcatttgcattgcatcgcatctctgcattgcatcatatatatattgtgtttagctgcttagttcagatattgtgatatcctgctttatagtctactttgtgttattcctgtattccttatctttagggctttctttcctgttattactcactaggtcggagtactcacattactccctgcaccttgtgtacagatctagggcatactcaggcggattagcttccggggttctcaggcgacagcatcggagtgttgaggtagctgcacggcgttcgtagccatcaactctccctctatccttatcttcagttttcattgtactttcagtttttgaacagatgtatcagatttatttcattatactctagaggctcggacttgtgacaccggttccttggtggcttatctttggttgttctgatttttccgcagttttcagtaattaaatctcgtatcttattaagctattgttgtttgagttcctttatttggggaaatgttggtattgtggtcaggcttgcctagcctcacggccgggcgccatcgcgatcgggatttggggtcgtgacaacttggtatcgaagcctaggttacttggtctcgcgagtcatgagccggtttagtagagtctcgaagatcggtgtgtagacgtccacatcagacctttgagaggctgcagaacttttaggaaacacttcatattcttgaaattcttgtcgtgcgattttgttgatccgagaactaaattctactattctattctctcgcagatggcgagaacacgtgcttcccgaggtgcaggacgaccaccagtaccacctgctagaggccgtggacgaggccgtggatgtggtagaggcagagctacagaggcagcacctattgatccaccagctgcccaggttcaggatcagacaccagctgttgagactctagcagcacctattcaggcaccggctgtgcctattgtgatttcgggtcttcaggaggccctggctcagattctatcggtttgcaccggcctagctcaggtcgtatcagcttttacagcagcagccacatctcagatagggggaggacatcagacccctgcagctcgcactccggagcaggttgttcagggcttgcagacacctgaggaagcccctattgctccagttgctccagcagcaccggttgccccagttgcgccagttgcgccagttccacaggttgctccggttcaggaggttatggttccggctatgccagaggacgagcagcgtcgtcttgagaggtacagcagactttcgcctccgactttcagtagggctcagggcgaggatgcccagggatttctcgacaagagtcgacgcatgctccagactgcagggattttggagactagcggagtatcattcactaccttttagtttacgggtgcagcatttacatggtgggagtcatatgagcggcgtaggcaggcaggagcagcaccgttatcttggctagagttctccactctcttcttggagaagtgggtaccgcagtcgcagcgagaggagctgcgtaggcagtttgagtatcttcggcagggtgatatgacagtgtcacagtatgatatgaggttttttgagttggctcgtcatgctccgtggatggtcccgactgatcgggagaggatcaggagatttgtggacgggcttatctatcctgttcgtattttaatgtccaaagagagggttttgacccattcctttgaggatactgtcgacattgctagggacattgagacagatcgccgtctggagagagaggagagagagtccaagaggtctcgaggatcaggtagtttcagcagtgccccgtgtaggggtcagtttcagcagggtagaggtcgccctttcaggcagcagcagccggcccgtcccgagtatcgcggggagtcttcaggccgtggtcatcagggttcacagcagggccagtcttcactgagtgcactccctgtcgacgcccccttttttcaactaaaaagagaagctgaaatcgggtttacgacattatgggcaaaacaaattagaagagtcgccacctaatgattatagtgcattaggacacttaaaaaataaggagtgcttttagatgaaaaccagagttcgggtaagggcttgagattatctcgaggggaaggtgttaggcacccctcaagatccacaagtgtggttcccggccatgctaattgtgactttagaaagagatgaagcaagtaaacaaatgaagtatacatgtatatcattcacatgatttgaaagctttaaagagaagtaaggacatgagtaggaaatagaagaggattagttttgaaaagcactaagagagaaagcatttaaataaagcacataaaagaaaaaatgggtcctaggtttgactataatatggatcatttggtgcaatacccagcaatcattctcacacgagatattagcgcaccgtcatcatctccatattctaccctcccaccccgttaaggtattaaagcgcgttggtatcgtttacttattgcatgttaatacccgtcccaacctgttgctcccttgccgggacgcgtggtaaattgttattgttgttcccttgccgggacttagtattgttgttgtattcccttgccgattcccttgccgggacttcttgtgttaattgttactcccccgccccgattgtggttgttgtttgggtgagttcgtggtatgaatttagaaggatcgggttgcacggcataatggtattaaataatgaggatcgggttgcatgccgcaacggtgttaagtgagaatggaacgggatgcacgccgcatcgactctgaatatagttggaacgggttgcacgccgcaacgaagtgtggattaagtgtgctgccagcatatgtggagttttctcgtatttccttttctgttgttatggaatagtgttaaatctttatccgatgatcgtatacctgatttgtcacaccccatagcatgctcccttccctcttaactggttatattacgtatattttcggtcattgtttatatatctgcacaggttatttgtggtatgtcctgtctagcctcgtcactacttcgccggggttaggccaggcacttaccagcatatggggtcggttgtgctgatgctacactctgtgcatttttgtgcacagatcagggagcagctttcgtaccgcagcactagaatttctgggagctatcttcagtccagggactctcgaggtagcctagctggcgttcgcgggccgaagtcccttctatgtttagtttgtttattttgtatcggacaaacatttatgtatttcctttcagacttgtatttagcattctgtagtagtccatgagtagtgacaccagactctgggtagaagtgtactgttggaacttccgcatttgttcctctgtattttagttttaaaaacttccgcttattttacctgcttcgttttatttatgttatcgtaagtgctagttaagaatgtttgattgttggcttgcctacctcctaatagtaggcgccatcacgatttccgatgatgggaaatctgaatcgtgacaattagatccaaagtatatcgagtgataaagacgttgttcaattatgaatagtacagaagcaaatttaaacctatttttataatgaatatcgttaatcggtaacttatgcaatgctcttttacagtcagaaatagcgagcaatttcgttaacaatgtacaagactattcaatcaacattcaacattaatgtatataaattaatatttgacctatatattattctacataacctaatttaataaaaatcttgcttccgtcactaacaaacacgatgttctacataaatttttgatgcaataccgaggtgttgggtctaacactaggcctttagattatactccttatttttcaatttatgcgaacgtatatgactgagcatgatatttaagaaaaaaaacttttgaatttgtagtataaattgagatacatatatattgtctaactatgaattattgtataaaagtaaattatttttaaatataaaaatgaatcattatttttagtacgagttaaaaaggaaatagatttacgtaaattgaaatagaggagtacatgacaatacttttccggatttagttaaattcaatacgaatactaaatatcaagtgaaaacctttttttttttaaaaaaggactagcctctattcattttccactagttaaatttttagtttgtgttttgttttgttttgtccttcctgttgctacttgcagtaaagtctaggtcgacatgtcttggcttgtagtctattaacattttggtactgtatgtacttttaattcgtgaaaaaaaaaatgtttgttaagtaatattaaagtgtccaataagagcaagcctattagttgaaatgtcaaaaggttggtatcaaatttagttagcaagcctattagttatttatgctcccgtttggccatagattgtggttactattttttaagtttaattttttttcaagttcccaaaaattgatttatgataatttgtgggtaaaatttttctttcactcacaaaattttagttttttttacaaataaaatatatgtccagacacaacttcaacttctaaatattatttttcaacacaaatttaaaaactcttttgtcaagttttagttaaatatatattaaactatgtattcatttctgcttatgttttatcgtacattttcataagtgaatttcatactcattgtattggtcagaatctcaccaagcaatagctaataagattaactattctccaaatgctatttacggctaacacaacattattagtcatcggtaatctccatgggcatctactcagcacaactagggaggctacggcctacccgtccccacggggacgtcctctcgacgcagccacggttgcccaacgacagctggcagatccactactataaatacgaagagattaaaccctaaatggggggctgttccttcttctgaaaaacactttctctctctaaagaagagaagaacaattgtaaggctctgaacctctccaaggagaggcagaccatctctacaaagattaataataaaacatttcccttctcgctatttgaggcttactatttcatatattttctctctgcttccttcatcttagtttgatattacgatctgctatgattggccgccaaatcttcgattgtttatgcttaagaggaattaaaacactttttagttaaacaatttggcgccgtctgtggggatttcatagcagaatcacgtagttcattcccaagtcgagaaggagcaacgattctgctcaaacgagccacaacgacatggtcctgaaaagaaaaaccgaggagctgcaacaagaactcgggctcttcgctcccaaaatgtatcagaagaagaagaaggaacagtaacccccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgccttcatcaaaagttcaactatgtgttgaactgggactcaggctacgtgccttcgacttcaaagaatccaaaagttcaaccacggttgaacgttctctcaggttacgcgccttcatcaaaagttcaactatgtgttgaactgggactcaggctacgtgccttcgacttcaaagaatccaaaagttcaaccacggttgaacgttctctcaggctacgcgccttcatcaaaagttcaactatgtgttgaactgggactcaggctacgtgccttcgacttcaaagaatccaaaagttcaaccacggttgaacgttctctcaggctacgcgccttcatcaaaagttcaactatgtgtcgaactgggactcaggctatgtgcctccgacttcaaagaatccaaaagttcaaccacggttgaacattctctcaggctacgcgccttcatcaaaagttcaactatgtgttgaactgggactcaggctacgtgccttcgacttcaaagaatccaaaagttcaaccacggttgaacgttctctcaggctacgtaccttcactcaaagtgcaaccatgagctgaactgggactcaagctgcggccgtattcaggctacggccttactcaggctacggccatattcaggctacggccttacttaggccacgtccatttttaggctacggccttactcaggctacgtgccttcgacaaatgacaaaggctcaaccacggttgaacaacaatttgagcaacggccatattctgtctacgtgcctttggcattaaggaataccaaaagtcgactgggattgaacatcgacccaggccgcgaatctccacatagaaagtcccgccatgagttgaattagggctcaaattcagcccgtgccaaatccaggacaaggaggcatgttcatacaattatgagccaaatcacgagcaatacgcgacgccccaaagcgctcgatcatagtcggactcgaactcaggtcatgaacccccactgttcaagtaagtacgattaatccaagctgaaaagtttcttatctacgaaaagtttggccaggctaaactataaggccgtgcttctcatcaccacggccggtagtctaaccaagcccgaactgggactaaggcttaaggctatgtgccgccaccgccaaacaagggcaacaacttactcacgtcaaaagcgtctaaacacggccaagaccttcggcgctaatagccaacctaattattgactaaggcacaaaaccaattcgacaacagtcgaaatcacccaactggccaaggccatttacacgcccactaaaaattcacacggctaaggccattatttcttaagtacgggtaaaaccgtcgaaacaaacgtcacatggctaaaagactgctaaaaggcaaaactgctcaaatgaatgcgaaaagaacaaaaagagatacgagattaaaagaagaaagttgcatatattcaaaaaaatttacaaaggggtcacccccagatacaagcggcccaaggccaactagaaaaaaaagaaaaaaaaggaaaagaaccgaaaataaaacaaacactacaaaaactactgcttggcgccccccgcgccatcaccaccgccactcgcgccttcggcgccatcatcgccatcattgcccctcggggtggccggatcaaaaccgcaatccaggcgagcttcacgagcctttaaacgggcactctcataaagagactcgggcacgacgccggcttcccacagcttcttataaacatcaagctgagcctcggcaaacgaccaaaggtcccgagcagggccataagaagcgacttggtccctcagacgctgattctccgcctccagggccacaagccggtccgccgcaagttgggcatccctctcataaatgccaatgcgctcctccaaccccgccaccctaaacgccgcagcagacctctccagctcccgttctctttcgcgaacgcgaaccaccgcctctagcgccccagccctcgtggaagcatcccttacctgccctctcagggtagcgacctcggcttccaaggtaaaaacctgcctcatataaatttcggaagatcccgccgaggcatcccggattcgcttctccctctcagcagcggtcctcttctcggcctccatctcttcgtccttacgacgactctgatcttcgagagcggccacccggctccgaaggcgctgcagctccaactcacgcctggccagttcttcgactaactcctggctgcggggatcatcccttaaacgctcacgcatctcccggcacctgtcccggtagcgacgatacttttcaagagcccgcaagaatatccccgagcggacgttgtgccagcgcatgctctctacctccaaaagataagtctgcaaagtaaaaattgcggttagaaaagaaaacaagtcgagacccaaaaattgacaagaaaagggcactgagcataccctaaaagccatcacggctgactcgaccatcaacccaacgtcggtaatgtcactgagcgacctactctccgtctccgagcacaggggcgcgaacatcggcaccaactcgtcctccacaagaaacaagttctgctcggtaggaatctcagcatagcggatcggtccctccgcatgcaccaccacattggtaaggccctcctggaacatgcggacgtcttcggggtccaagtcagactcggaatcgtcctcccctactgaggcgcctcttccttaggccgccctggaagtcgaagcctcggccgccctcgaagtcgacgcttccaccgcccgggaagccggaatctccgccctcgccaagacgggagcatcagcctccccaaccgcgacagccgccacagaaccttctcctccctcaaccggaggaaccgacagttgagccgccaaagcgacgttctctccatggcttacgccaaccggggcaacccccattgtgttttcgccctcaaggacaggcacagccgcctcatctccctcagccacctcgtttccctcagccgcctcatccccctcagccgccgacggtggtgaatcaagattcaccacttcaatagcgggcatgaatgcaactgtgacgacccaatggggtcatcaccataaatgctccttgttccgagcttctgaggccgcaaaaacctcttgagaggttgcctcgatatgcgtgcacagtccgggcgcaaagctggaaagattttctatgttgaagaatgaattctgtgttaaaattgataaatttcaagtataatgatgatatagttgactccggtcaacattttgggcaaacgggttcggacccgtgtcgtatcaatttctaaatatccgtcataaaatttgggactcgtgcatatgcccggaatcgaatttcgaggtcccaggcccaagatacggaattttctgtgaaaatagtttctgaaaatatcttaagtctttgaaaatgaagaattgatttttaaatgtcgtatcgggctcgtattttggttccgacgcccagtacaggtcttatatagcgtttaagcgcttcctgtgtaatttgatcgaattcggacgtcgtttgacgtgattcggaccctaatagctaatttgagaacttgaagtctaaagttgaaaatcatggattttatggtttgattctatgtttttgatattgttttagcgatttgatcgctcgagcgagtttgtagaaggttaatgagttagtatgagtgtttggttgggagccccgagggctcgggagtgtttccgggggtggttcggagggtattttggttgaaaaatctggtgttttggttcagttgttgcagaccctgggaatgctctatgcgatcgcattcaagcccccgcgatcgcatagagcagtttgttagtcccatctttttgctctctacgatcgcagacagcctcctgcgatctcgtatcttggccatgttattcaatgcgatcgcgtcccatccatgcgatcgcgtagtgcagagtagccccgcccaggtcagccctcctttcctctctgcgatcgcgtgcctacctatgcgatcgcgtaagccttggtcctgctatctctatgcgatcgcatccgtgttcctgcgatcgcatagagcatttttccagcgattttcttttaattcaaaacagtgtgtccgcgactctaaccccatttttcatccgagagctcaaccaaaaacctccattggcgaaaatccaagctcctaatcttcataaacctttgggtaagtcaatcctaactcgattccttcatcatttcttctccaatcattgaattcccactctttaaatcatgaatttaagctagaattaagggtttttggggtaagctagggcttatgggattttgagcttttcaacctcgatttgaggtcgaatttaaattctaattatatatttgaactcgtggggatatgggggattgggttttggtccgaacctcgagtttcgaccacgtgggcccggggtcggattttggaatttttggaggaaagtttgggatttcatttctaggctttggagttgaatgattgagttgttattgatgattttgaatctaatattgcttagatatcgttgtttgggagttggattcgaaagggaaggcggttgtagagctttgaattgctagttcggcattgaggtaagtgtttgttctaactctagttcgagggattaggattaggaagttatttgctatgtgttacatgggtcggtgtataggtttggtgacggttatctatgcacccgagtcaaagcatgaccgtgggtctttacttgaagttgttgaaagctatgttgtggattttagctattgaattgatccttgaaagtaaagtgttggatttcatatgacttaaatggcttaattgaaaacttaaagtgaattgccatgtctagtgaggttgaattctatatgtctcttgtgttccttgcggggatttattggttataactgtacccttgccgggttagataaatatgtgtaaattgttgtgtttttccctgtgataggacttgtgtataaatgaattgagctgaaaaatatgataatatgagggcgggtggtacgcctaccacaagatatgataatatgagggcgggtggtacgcctaccacaggatatgataatatgagggcgggtggtacgcctaccacaagatatgatgcaatgagggcgggtggtacgcctaccacaagatatgatgcaatgagggcgggtggtacgcctaccacaagacatacttatacttgatgttttatcattattgattcctgaatatctatttatttggttgcactttaaaatattgaactgttcccctatagcatgtcccctcccatacttgtttaattcatgctttatttttcctgtttcgcatatatatatatctgtacaggttaacgctgtaggtccggtctagcctcgtcactacctcgtggactggggttaggccaggcacttaccagcacatggggtcggattgtgctgatactacacttctgtgcccttttgtgcacagatcccggagcagcatttggagcgcaccagcactgactgtggagtcagcccttcagtctagagtccgagaggtagttcaccggcgtccgtggaccctcccgtctcttccatttgatttagtttgttatctgttccaaacagacagctatgtatttttcatttcaaacgttggttgtagtgactctttagaagtctgtacgctgtgacactatttcttgggtaggagttgtactagttttgcttccgcgtttgttttaatgaaagtaattaagtcttccgcttatatttttttctgcatttaagctattaactgtcaattataaactgttgaatgtatattgttcggcttgcctagctccgacagtaggcgccatcacgacacccgtcggtgggaaatccgggtcgtgacaagttggtatcagagcactaggttacttgagtctcacagcttacggacaaactcggtagagtctgagggagcggtacggagacgtctgtacttgttccccagaagctacagagttaggaaaatctcactttattcattcttgtcgtgcgattctgtttctcaatattgattgtctctctattctgtttcttcgcagatggcgagaactcgagcttcctcttcttctgatcagcaggccgatgccccagcagcagttccagttaggggcagaggacgaggtcgcgctagatgccgtggcaggggcagagctcagccccgagccgcagtgccagaggtggagccccagattgaggctgaggggactccagccccagctattcctatggtcgtcccgggtcttcaggaggccctagctcagatcatgtcagcgtgctctagtctagcacaggtgatctcagccaccgccgcagtttccacttctcagactgggggaggtactcagaccccagttatgcatacacccgagccagtggtgcagggacttcagactccagaggcaccacctgtgcaacaggttgccccagctccttcagttgtgccagttcaggcagttgctgtgggccagactagtgatggtgcggcgatgtccgcggatgctttgtggaggcttgaccgtttttccagattatttactcttaccttcagtggtgcaccttctgaggatgctcagaactatctattcacttgccatgagacgttgaggactatgggtattatggagactaatggagttgactttgccacttttcgcctgactggatccgccaagacttggtggagggatttctgtctatctaggccagcagggtctccagctttgacatgggatcagttcgcagagttgtttttggggaagtttctccccgttactcagagagaggctcttcgtcgccagtttgagcgactccagcagggatatatgacagtcacgcagtatgagacgcggtttgtggacccggctcgtcatgccttagtgctacttcctacagatagcgagagggtcaggagatttgtggatgggttgcatccggatattcgggtgcagatggccatgaatgccggtggtggtctatctttccaggaggcggcggatggtgcccgccgtattgagatggcattgtctttgggaggcggtactgggtcagataagaggccccgttgttctggtcagttcagtggtacctcatctggaggtaggggttcacatgctaggggccagcctccgaggcctttccagtcagctctccagacttctcagggtgccccaggtgggcgtggttcacaggttcagtcctccgatcagcagttgtacagttcgccttccgcacccatcagtgcagctcctttgagatttactcagcagaccggagcttgttatacttgcggcgatactagacacatcgccaggttttgccccagagcttccagcagttcgcagcagcagggaccccgtcccatgattcaggcaccacctgccccacagcctgcccagccagctagaggcgggggcagaggtcatagaggtgggggcagaggccttagaggtggagctcagacagctcgtggtagaggtcaggcagttgtagatcagcctagagatgtcatacagggaggtggggcccagccccgttgctatgctatgccggccagacctgaggccgagtcatctgatgccgtgattacaggtactattctggtctgtgatagagatgcctcagtattatttgatcctggatccacgtattcctatgtgtcatcatattttgcgccttgtgcggttatgcctagtgaggccttgagtattcctgtccatgtgtccactccagtgggagactctatagtagtggaccgggttcatcgctcgtgtgttgtggtattcaggggtcttgagacccgtgttgacatattgttgctggatatggtggattttgacgttattcttgggatggattggttatctccttatcatgcgatcttggattgtcatgccaagaccgtgaccttggcgttgccggatatgccctgattagagtggagagggacccccggtcgtaccactcgtagtgttatttcttatatgaaggctcgacgtatggtcgagaaggggtgcttagcttatctggcttatgttcgcgattccagcgctgaggtcccgtctattgattctgtccccattgttcgggagttccttgaggtgttcccttctgatttgccgggcatgccgcccgacagggacatcgatttctgtattgatttggcgccgggcacccagcccatttctattcctccttatcgcatggcgccgccagagttgaaagaattgaaagaccagcttcaggatttgcttgagaagggtttcattaggcccagcgtgtcgccttggggtgctccagtcctttttgtgaagaagaacgatggttctatgaggatgtgtattgattaccggcagctgaataaggtaacgatcaagaacaagtatccactgccgaggattgatgacttatttgatcagcttcagggttcgaaggtattctccaagattgatttgagatccggttatcatcagttgaggattagggcgtctgatgtccctaagactgtttttcgtactcgctatggccactacgagttcctggttatgtcatttgggctgactaatgccccagctgcgtttatggagttgatgaacagagtattcaggcctttcttggacttatttgtgatagtcttcattgacgacattcttatatactcccgcagtcaggaggagcacgagcagcacctcagagtggttcttcagactctgaaggatagtcagttgtatgtcaagttttctaagtgcgagttttggttgagtttagtggcgttcttgggtcatgttgtttcagcagagggtattcaggtagacccgaagaagatagaggcagtcaagaactggcctcgaccagcttcagctacagagattcggagcttcctgggattagctggttattacagacggtttgtagaggggttttcatccattgcatcccctatgaccaggttgacccagaagggtgccttattcaggtggtccgacgagtgtgaggcgagctttcagaagctcaagacagcattgaccacggcaccggtattggtattgcctacaggttcaggatcgtacacggtctattgtgatgcttctcgtgttgggcttggtgcagttttgatgcagaatggtaaggttatagcctatgcttcgaggcagttgaagatccacgagaagaattatccagttcacgatctcgagttagcagcgattgttcatgccttaaagatttggaggcattatttatatggtgtgacgtgtgaggtttacactgatcacaagagcctccagtacttgttcaagcagaaggagttgaatatgaggcagaggagatggttagagttgttgaaggactatgatgttacgatcctatatcatccgggtaaggccaatgtggtggccgatgctttgagtagaaagtcagctagtatgggtagccttgcctttgttccagttggtcagagatcacttgccatagatgttcgggccttggccaatcgttttgttagattggatgtttcggagcccagcagggttttggcttgtacggttgcccgcttttctctttttgagcgtattcgcgagcttcagtttcatgatccccatttatgtgtcctgagagacacggttcagcgaggaggtgctaaggaagtgaacctgggagatgatggtgtattgagattgcaggggcgagtttgtgtgcccaatgttgatggaattcgtgatttgatcttagcggaggcccacagttctcggtattctattcacccgggcgccgcgaagatgtatcaggacttgagacagcattattggtggcgtaggatgaagagagatatagttgcttatgtggcacggtgcttgaactgtcagcaggtgaagtacgagcatcagagacctggtggtctatttcagaggattgagcttcccgagtggaagtgggagaggatcactatggatttcgttactggcctcacgatgactcggaggcagtgtgattcagtttgggtgattgtggataggctgactaagtcagcgcacttcattccagttgctaccacctattcgtcccagagattggctgagatttacatcagagagatagttcgtcttcatggagtgcccgtgtctattatttcggaccgaggtccgcagtttacttcacgtttctggacagccttgcatggagagttgggtactcgggttcaaatgagcacagcatttcatccacagacggacggacagtccgagcggacgattcagattcttgaggatatgcttcgagcctgtgtcattgactttggaggctcgtgggaccagtttttgcctttagcagagtttgcctacaacaacagttatcagtccagcattcagatggctccttatgaggcgttgtatggtaggccgtgcaggtccccagtcggttggtttgagccgggagaggctcggttattgggtgttgatatggttcaggaggccttggataaggtcaagattattcaggacaggcttcgtacagctcagtctaggcagaagagttatgcagaccgcaaggtcagagatgttgccttcacggttggagagcgagtattgctccgtgtgtcgcctatgaagggcgtgatgaggttcggaaagaaggggaagctcagccctaggttcattggtccatttgagattctagagcgagtgggagaggtggcctatagacttgctttgccacctagcttatcagctgttcatccagttttccatgtatccatgctccggaagtatcacggcgatccctcgcatgttttagatttcagcactgtccaattggacaaggatctgtcttatgaggaggagccggtggctattctagaccggcaggttcgacggttgaggtcgaagagttttccttcagtgcgtgttcagtggagaggtcagcctcctgaggcttcgacctgggagtccgagtccgatatgcggagccgttatccccatctttttcccgactcaggtacttctttcttttgtccgttcgaggacgaacggttgttttagaggtggagattgtgacgacccaatggggtcatcaccataaatgctccttgttccgagcttctgaggccgcgaaaacctcttgagaggttgcctcgatatgcgtgcgcaatccgggcgtgaagccggaaagattttctatgttgaagaatgaattctgtgttaaaattgataaatttcaagtataatgatgatatagttgactccggtcaacattttgggcaaacgggttcggacccgtgtcgtatcaatttctaaatatccgtcataaaatttgggactcgtgcatatgcccggaatcgaattccgaggtcccaggcccaagatacggaattttctgtgaaaataatttctgaaaatatcttaagtctttgaaaatgaagaattgatttttaaatgtcgtatcgggctcgtattttggttccgacgcccggtacgggtcttatatggcgtttaagcgcttcctgtgaaatttggtcgaattcggacgtcgtttgacgtgattcggaccctaatagctaatttgagaacttgaagtctaaagttgaatcttaaggattttatggtttgattctatgtttttgatgttgttttagcaatttgatcgctcgagcgagttcgtaggatgttaatgagttagtatgagtgtttggttgggagccccgagggctcgggagtattttcgggggtggttcgggaggtttttggtctcaaaatttctgcagaattgctgcaatatttgcccagtgatgtccttctatgcgatcgcatggtatgggctgcgatcgcatagcgtccgttgaagcctcccagaatttgttcaatgcgatcgcattgttgctcctgcgatcgcgttcctttgcccctctgtgcagtgcgatcgcatgctctcgttcacgatcgcgtagagtaatttccccctcagcccaggcctccccattctttctatgcgaacgcaggactgtccctgcgatcgcagaagcttgacccccactcctctatgcgatcgcaacctcagttccgcgatcgcatagaccaaatgcccagcgaagtattttaagtccaaaacagtgtgtccgcgactctaaccccattgttcatccgaaacctcttccaaaaacctccattggcgaaaattcaagcttcctatcttcaacaacctttgggtaagttaatcctaacaccattccttcatcatttcttcagtaattattgaatcttccctctttaattcatgagtttaagtaggaaatgggggaaaagggtagaaactagggcttttgtggttttggggatttcaaccccaatttggggtcgaatttaaaaactaattatatatttgaactcgtggggatttgggggattgggttttggtccgaacctcgagttcgaccacgtgggcccggggtcggattttggaatttttggaggaaagtttgggatttcatttctaggctttggagttgaattattgagttgttattgatgattttgaatctaatattgcttagatatcgttgtttgggaggtggattcgaaagggaaggcggttgtagagctttgaattgctagttcggcattgaggtaagtgtttgttctaactctagttcgagggattaggattaggaagttatttgctatgtgttacatgggtcggtgtataggtttggtgacggttacctatgcacccgagtcaaagcatgaccgtgggtctttacttgaagttgttgaaagctatgttgtggattttagctattgaattgatccttgaaagtaatgtgttggatttcatatgacttaaatggcttaattgaaaacttaaagtgaattgccatgtctagtaaggttgaattctatatgtctcttgtgttccttgcggggatttattggatataactgtacccttgccgggttagacaaatatgtgtaaattgttgtgttctccctgagataggacttgtgtataaatgaattgagctgaaaaacatgataatatgagggcgggtggtacgcctaccacaagatatgataatatgagggcgggtggtacgcctaccacaggatatgataatatgagggcgggtggtacgcctaccacaagatatgatacaatgagggcgggtggtacgcctaccacaggatatgatgcaatgagggcgggtggtacgcctaccacgagatatacttctacttgatggtttatcgttattgattcctgaatatctgtttatttggttgtactttaaaatattaaattgttccgcttaattttatgtctttaattataaattgttagttgtaattggttatgtgaatactggatcggcttgcctagctccgacagtaggcgccatcacgatacccgttggtgggaaaatccgggtcgtgacaggctgacagcaaccctacgtctggtcaaaggcctctcctccgcctcctcatcctcatcagagggcagactcgcccggggacgaaccacccccgaaggcgcctcaactcgagacaatgagcgcgccggggaatgggccgccgaagattcgatcgaagccgccctcacggccggacgtggcgccgccgccgcaaccaaacgagcaagtgcacccggcctgcggaaagcgagtggaggagccctcactagacgccctccccctgaacagcaaaaggaaagggatgcaaagttagaaagatagaaacccggggtaaccaagtaaaggcgacgcaacaaatcaaaacactcaccagcagcaggcctacggccatgcctttcccagaaggatgaccacgtacgaatccccgccgaatgaggaagcacagcctcgacccattcgccaacatcaggcacaggggccggcggcccacgctcggctgcaaaataagatcagcgtaagcacgtcaagacaagtaaggacgtgagagcctaactcggcagaaagagaacttacgtgcatggttccaagtctcgggaaacccatcaacattcgccactaaatgttcggttcgaacgtagaagaagttttcgtaagcacgaggatcaacctcgtcgtccagttccgcggtcatgcccctaaccccacgagggaccaaccggatcatcgagccgcggacgccctgagcagcatacagggtcagcacgtgccccagagttacctccctttgggccagctccgcgtacttagccagcatggcaaggagcttatacaccgaggggacgagctgcccggacgataccatgtagtaacggcataacccctccaccaacggcgggagtggaagtttaaatcccagcctgaagggatacgcgtagaaaacgcaatacccagggcggtcgacataaacccgctccgaactcagggccagaaccatgtcaacagaactggcgataccccactgctcccttaattgagcaaggcccacttcccccatcaatggggcttcgccttcatgagtctctccttcatcggcggagaagtcggtcgccggacctccgggcaaagccaagacatcagccaccgatggaattccctcagcatcggccaaaacaatagaccgcaccaccgtagaagaccccacaactgccggggaagtagccggagtaagattcgtctgagagctacttgccattaccgatcgccaaaagaacagggaagaagtttcaccggaaacaaggacgaggatggtaccaaatagaaaacacagagaaatggatgaacagactttcagagagaatttgcttcaatgcttgcacttaagtagatgatgaaaatgcgaagaataaatgccccaacctcttatttatagaccacgaaataactctcgcaaatcccgaaacttgtcattaactgcatgaccaactgtgaaacggttcaggtctacagtaacaggctccattatgacgaatcattatgaaacggtcactcagaccatcgaattgatgcgtcgcttctaacacgtcatggcgatctcataactgtcgagggcacgtcctcttcagggccgcccccaggataatagcagccacggtcgcccccaaaaataacgctctggccacggccgactctgagcaaaatagcggtcagggccgccttcagaatatatcgtacggctgcggccatctcacacctacgaacggctacggctagctcccaaatataagtgttcacgaccacctctcaatcgcgaatggctacggccgtccgctaaaatataaaaggttaaaatcgtcacacgaatatataaggccacggccgtctcctgagcacaaacggctgaggtcgtcttcaaagcatgaaataaattgtggttatcctagacaacgaccgaatcacggcctcgttattgttcgatcctcatcttcgaagtctcgcaatacataagttgcatgatccgctcattgagcccgatcgacgcacgacctcaataagcggagggactatctgtattggtcagaatctcaccaagcaatagctaataagattaactattctccaaatgctatttacggctaacacaatattattagtcatcggtaatctccatgggcatctactcagcacaactagggaggctacggcctacccgtccccacggggacgtcctctcgacgcagctacggttgcccaacgacagctggcagatccactactataaatacgaagagattaaaccctaaatggggggctgttccttcttctgaaaaacactttctctctctaaagaagagaagaacaattgtaaggctctgaacctctccaaggagaggcagaccatctctacaaagattaataataaaacatttcccttctcgctatttgaggcttactatttcatatattttctctctgcttccttcatcttagtttgatattacgatctgctatgattggccgccaaatcttcgattgtttatacttaagaggaattaaaacactttttagttaaaaactcatcttcatgcaaacacttatactataaaagatatattattcctaaatacaacatgtgatatgagatcattacattgtaagtgtaccttattattggtaatgtttggacttcacccaaaaataattaaggaagtaatgatatgcaataaataaataaagttgaaaaaattaaacttgactcgagacacattaggttatttgtctccttatttggtcataaaatctcgagtaatccatatttcaaggctagcaattttttagagctgaattaagtttaaaattcatttctttcgtgtgagcgtgcggggtgttaagcaggggctgaggaagagcattagtcgcgggctcagatgaactaagtagttgttatttaaaccttgtatatgtattagaaaatacataaaatatgtataaatatttaattacgaatctaataactaagataaactatgggttaatgataaatcaagaatctataaattttaattcctagttccgcctctggtgttaagctgtccaacagtaaaaattgcactagggcgtccccttttaacctatagccgctttatctttttgcttgcatccgtacccactttttcacataacttcaacccacggggctgaagtatttattttataactgggcaacttaagctggaaaacggcctaagtgtttattttataactggacaacttaagctggaaacggcctaagtgtttattttataactggacaacttaagctgcaaacggcataagtgtttattttataactggacaacttaagcctaacagcctaagtgtttattttataactggacaacttaagcctaacagcctaagtgcttattttataactggacaacttaagcctaacagcctaagtgtttattttataactggacaacttaagcctaacagcctaagtgtttattttataactggacaacttaattagcttaacagcctaagtgtttattttataactggccagttaaggaagaacacttctgcctaacagctgaagtatgttgaaaaagcgggtatgtttacaaacaaaaagacaaagcgggcacaagttaaaatgtggcacaaaaaacggatacggctgcaaatcccccacatttgttgagggatgggttgttatatggtcttgggcaagagttggaatcactcgggggagaaattcaaaaatagccagatttaccgccggttattgaaaaatagccacgtttcaaaagtcatcgaaatatagccactttttatataaaggtaaatctgagcgaaatcactgttcaaaatccggaaaaatactccagtatattatactggagttccgacataagtatgcttgaactccagcatattatactggagttccaggatagcataagtggaactccatcataatatgatggagttccagcataagtacactagaactccatcataatatgatggagttccagcataagtggaactccatcataatatgatggagttccagcataagtacactagaactccatcataatatgatggagttccagcataagtacactacaactccatcataatatgatggagttgcagcagtataattgtccagtataatatactggagtttggagcactggtgctccagtctccagtataatttacaggagttggcaattataccggtctcattaaaatatgctggagttcgtacaaaaatgcactagaactccagtatattatacgggaccggtcctgttgcagcaaaatagtggctatttttcattgactttgtaaacggtggctatttttcgatagccagccgtaaaagtggctacgccgtgatattttgacatcagctcggccaccaacatttggcccattgtttcccgttaaaacaattcgcccaaagttgatctatttggcaagtggccatgtgatgaacttttttttttttttttggaaaattcctaggaaaccggcagccgtaggaaacccgcagtccctagtaccctttgggtgcgcactggataactagtttactgtgcaattgcccttaaatcacacaggaaatataaatcgcattagacacgtccggtgcgacaagctctgactgaggagattgctggtgaggggaatcgatctcaaatctcccacgtgagaaatcaccacccaaccaactaaaaccatggcgggcttgacttcaaagtaagtcttttgtgaaggctttctttttgtcatttttctcccttgttcagaacaagttgttctgacagttgcacgagacattattaagttctataaataggggagaaacattatttcccttttcacatcaaaacttgaaactccaaatagctcatcaaaatgttttccaaaactagcctttttctttgcctttctttggctattttactaatagtaatatcctcacaagctgatgcggagacgtctaaggcgcctgctacaataacccaaggtttatttacttcttcaatctattactagtagttattcacttttaacattttgagttagcaaaaggattttataaaatgtttaaatattcatctaacatttttctttaaaatttgtgattttaaaatatgttatgatatcctataaagaagtattattaataaaaatttggaaattccggattaaaaaattgttaaatgttggtggcattcttttttaaacggattttttttttaaaaaaaaagtaaaaggcatagattaaaacagcaggagtaaatgtttacataatcatttagcattttactgacggtttaatggacatttttaaacattctacatccaaagtatttagtgatcttatgatatatatatatcgcaacaccgcagaagtttcttctttttatctttattgaattcggtaatataatagtttaaactctattgctagagcaaggactcttcaatttaattacttataggtcaacattcattcatacatgcgggatgcatgactatctactgaccttctaccctaattctcgacctccacattcttttatcaagagtcatgttctcgataattatagaagccccatttcctgccaactgtgtgatcatttaatttacggaaaaaggcctaaaatgcctctgaactatccgttttggtacaataatgccctccatccacctattgggccaaatatgcccttccgttaatgtttttggcttacaaatgccctttgaattaacggagggacacgtgtcatcctcctgttagctcattctaaatatttcttaattaattaaaaagacccattattcatacctgaaaaataattttctaaagcaatttttctaaaacttttttttactaaaaactaaagaaaaaaaggatttttttttcagtttttacaaaaaaaaacagattttttttctaaaacaatgcttttgtaaaaacaaaaataaaatctaaaaagcaattttctaaagtaatatttttgtaaaaactgaaaaaaaaaaactaaatgttttttgctaaaaactgaaaaaaaaaaaaaaaatccaatttttagaaaaatatttcagtttaaaaaaaatatttttctaaaaactgaattttttttttccagtttttagcaaaaaatatttagttttttagaaaaaactggcaggtgttctatacaccattcatgaggcatatctggatgtggttaggacttgcacccgcatttacagtaaagaaaaatatttctttaaatttctttaaaatccagtctttaaagaaatatttttctaaaaactggaattttttttttttcagtttttagcaaaaaaacatttagtttttttttcagtttttacaaaaatattactttaaaaaaattgctttttagattttattttgtttttacaaaagtattgttttagaaaaaaaaaatctattttttttttgtaaaaactggaaaaaaatccttttttttctttagtttttagtaaaaaaaaagttttagaaaaattgctttagaaaattatttttcatgtatgaataatgggtctttttaattaattaagaaatatttagaatgggccaacaggaggatgacacgtgtccctccgttaactcaaagggcatttgtgagccaaaaatattaacggaagggcatatttggcccaataggtggatggagggcattattgtaccaaaacggatagtttaggggcattttaggcccttttccgtttaatttaaaacttaagttgttagatgaggaacacgttcatcctagtttatttatgtcggcggagaatgaccccttatggcacggcttagtcagttattctcgcagttcagataagattcggaccgggcgaactgcattcaaagaccatttaaatggcagaagccaaaactctgaaacgcattcccttgccttgagtgaaatggtgggaatccttgtttgccgcgctgagatttaatactatcacatcttaatttcctcctttgttagttaacctataactaatacattactctacataaccaaatttggtgcagcaatgaagatgggtgcaggaatccaaggcgtcggcaaaggggaaggcaaaggcgtcggcaaagccgttggcaaagccgtcggcaaaatcatcggcaaggcttgtaaattttgctcatgtgaaaacaagatttgcagcaaatgtcctaaatgtgatcgcccaactcccgtcgtcaatgcttgtaaaatttgctcatgtaaatacaagatttgcagcaaatgtcctaactgcccaactcaagtcggcaaagcttgtaaaaaatgcgcatgtaaatacaatatttgcagcatatgtcctcaatgcaaaaactaaagttaggcctcagagaatatatacttgtgctggtgtgagtttagttttgagaataaagggaaagctatgaatagcctaattatataattctattcactttattttgttagtagttcttattgttacaacttgcaacaagtctttgggtcaaaatgtacctcttgtcttgtggtctttcaaccgtatggtattgtattcctgtatttttctttagccacttgatatcttaaaccaaatccgattaaatcttatttgcgttgcatatgttagtcatctagacttctctattacagctgtcacgaccctagttcaccaattgtgaacatgtcatgacgacacctggtctgcgagaccgggtaagcctaacacattgcagaattcaacaaccattatgaaaagtaacagcaaaattactgaaaaacaagacaaatgtatactttgccgcgtggcacatacactttactgaaaatatctggaacaactcccagaacccagaaactcacgggcaacacaggctaagaattttacatgaactgctctaaccatccggagtagtctagtacaaagggaagtggaatgacagctagctaactaaggatagagtgagtgggagactagtaggatctgcggacgtggcagatgaatacctcaagcctccgtaaagctccctgcagctactgataatatgcctgcgtagaggtacctggatctgcacatggaaaacatgagcagaagaggcgtgagtacaccacagcggtactcagtatgtgccaagcctaacctcggttgagtagtgacgaggaaggtcgaggccctaccgagataaatataataaagaggagaatatgcaatatatagatgatcagttaaataataaggaacgacagcagtttaaagagaaatttcgaataacccacagtcaaagaagacaaagaatacacacagcaaagcaataatcagaaccaagtactcagaggatctcccaggataccgtcctgtagttctttctcaactgtctcagtggggatctcccgggataccgacccgtagtccatcatatctgtcatatccgaaggatctcccgggataccgacccgtagtccaacaaatctatacccagtactgggggaatctaccggctgcattaccgtagttccatacatttgtgcagggggagctcccggaatcccacatccatagtcccaaaataaacaaggaaggggaaactcccggaatcccacatccgtagtcccaaaataaatgcacaaacacaacaaaggatgtacatgaattaaattacaaaacaccatcagttaaggaatctagcctaacatgctgcacatagagcaatacgagcaaaataagcatttaacgatcaattctatctaatcatgctttcctaactatcacaggttgaactgacattttatagaagtcaaataagcggagaaacacggtctaagtaattcaagtaaggtggaattcaataattagcacaagtgcacgctcgtcacctcgcacacagggcatttaaatcaacaaataagagaatcctaagggaaaagtcccccacacaaggttagacaagccacttacctcgaaccgacacaaaaatcactacaaagcagtgcccttgccacgagtatgcaattccgaatggcccgaatatattcaaaccaattacataatataaataacatcgcaagtaactaattacactaataagattaaagcaacggcgcgaaaataggtaaaatgaccaaaatgcccctcaggccaatatctcggaatcagataatttttacattttcagaaacctcgttctctcactagtctaaccatataaagttctcccaaatcggaggtcaaatgccccttcaaatcatcaaggttaggtctaagaactttaccccaattttcaaccaaaatcagaaattaaagctttaattcgagtttagattagtgggtaataatcataagggagtaagaaatcgttacccaatagttgcctctgaaaaaccctcgaaaaatctcccaaaaccgagctccctagcttgagtttttgtaaaaatggaagaaggttcgtgtttgaaatattatatactatttcagtgaattgctctatgcgatcacggaagaactgatgcgatctcatagagtaaaaagtgacagcccaagatttggtctacgcgaaagcaacgaaaggaatgcgatcgcagaagaaaaggagtctgagcctatgcggtcgcaatggggaatatgtgatcgcatagaaaaagttggtccagaggcccaggctctatgttgctctatgcgaacgcggcaacagaggtgcaattgcactgaaggaagggacaatgctatgcgatcgcagagtgatgtctgcgatcgcattgaaggaaattttggccagctcaagggactctatgcgatcgcggaggactctatgtgatcgcataaaaggatcttctgcaacactaacagcagaatttctgaaatgctccaagttccggaatggctccgttgagcatccgaaacacacccgaggcccctgggacctcaaccaaacctaggaacataacccataacatcattcaaacttgtatcaatccttaaaccacctaaaacaatgccggaaacatgaattaatcaatgatttgaacttagaaattccaaaacttaaccaaactcgctttcgatcaaaaacctaaccaaaacacgtctgattgacctgaaattttgcacgcacgtcccaaatgacatgacggtgctacagaaactttcggaatcccgttccgacccttagatcaaatattcactatcggaccgaaaacttcaaaattctaactttcggcaattctaaccaaaatgagctacggacccccaaaatacattctggacacgctcccaaccccgaaatcacctaatggagctaacggaaccatcagatttccattccgaggtcgtcttgacactgttccgactacggaccattttccaatacttaaactctcaaatagggactatttgtcccaaaacactccggattcaaataacgaacatcccggcaaaccaaaataacataattaaacttagggaaagcagttaacggggaaacggggcgcaaattctaaaaacgaccgaccgggtcgttacatcctcccacacttaaacattcgttcgtcctcgaacgagcatagagaacatacctaaagcagcaaaaagatgagggtaacggctgcgcatatcccgctcggtctcccaagtcgcctcctcgatcggctggccccgccactgaaccttcactgaggctatctccttagacctgagcttttgaacctgcctgtccaatattgccacaggctcatcaacataggacaagtccttgtccaactggattgaattgaactccaatacatgggacagatcaccgtgatacctccgaagcatcgaaacatgaaataccagatgaactccggccaaaccaggaggcaaggcaagctcataagcaaccttcccaattcgcctcaaaatctcaaacggaccaataaaccccggacccaacttccctttcttcccaaacctcatgacgcctttcataggcgagacccggagcagaacccgctccccaaccataaaagaaacatcacgaaccttccggtccgcatatctcttctgtctggattgggctgtacggagtcggtcctgaatcaccttaaccttttccaccgcatcctgcaccaaatccgtacccaatacccattagtcatctagacttctctattacaacatccttatataacaccctttcattataaaagccaaatttttctttcctacagtggattatgcctaggggtggcaatttgagcccaaacccatttaacccgcccaactaacccagagattaatgggttgggctacaacattttagctcatgggtcaatttgggttgagcccaagttaaaccattattttttatagcccattatgacccatttaacagcccaaatacaacccatgaaactcatccataacaaaggatctcaacccaagttatctagaaatttacttacttgtcccaatttatttatttttttgtatttttaattttttattcttttgtttatctacaccaaccacccactcaccctacccctacccccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccctatccataaaatatttgtcaacttacatattttaaggaaaaatattttttttatgcaagatgagcatggttctaaaatatgggtcaagttgggcgggttgggttatgacccattgtttagcccatcttgacccaacccatcttagcccaaatatactttgggctgggttgggcaatgacccatttattacctagcccatcttaacccgcccaaattcagcccaacccgcccatttgccaccccttattatgccatattcaatatttacagcaaagattgcatataggtaattatttattactattccgtaatcatatattagtctcatatatactattccgcaaatttaaaccctttataatgaatattgttaatctgtaacttatgccatattcaatatttacagcaaagattgcatataggtaattatttattattattccgtaatcatatattagtctcatagatatactattccgcaaatttaaaccctttataatgaatattgttaatctgtaacttatgccatgctctttaagtctcagatctgtctacgctacagcaacaacaacctagtataatatcactagtaaggtctgaggagggtagagtgtacgccgacctagaggatgtttccggtagaccctcggctcgaaaaagataaaagaaggacaacaacaaccatatcaatcggaaaaccagagcaaaaatacaaaaccaaccgtaagtattgtaatcagaaagccgaaacgaaagcaacaagtaataacagaagtcaaggggtatgacaatacacagacatgacaacactcggctacctatcttaaccctttaccattattttcaacctccataccttcctatccatggtcatgtcctcagtaagctggaacaacgccatatcctgcctaatcacctctccccaatacttcttcagcctgcctctacctctcctcaggccctccaaggccaacctcttgcacctcctcaccggagcatctgtgtctctccttatcacatgcccgaaccatttaagtttcgcctcccgcatcttttcctccacaggggccacacccatcttgtcccgaataactccgctagtagggtaaaaaaacaagggagagaaatgaaatgcaaagatgagagaaagcaatggcaaagccagcaatttcattaagaatgatcaggactgttccacattcaatataatgtatacaaagtaatatttgacctatatacaccgtacaattctcaagcaaaaggtatttaactggcctcccttgacctatgtagctccaccattgcaaggaattattagtgtatttaaaaaggttttcaaatggctacaagaaggatccgttagccaagaaggatcaacagtaatgacatttcgcatgtactgacgatccgttgaaacaagagaatggtatactatcaaatttgagagaactcattataaacttaagatgtaacagaacataataacacttcaacttatctagttttattttttcctattttatcctaaagtaaccagggacaatatccaaatatgctataataggatgcaacaatttggaacatccactgtttgttaactatgcattcgactcaacaagtatagccttaaaataaaataaatgcagcacctttctttagagcgtatagcagaagtgaagtaataagatagttccttggactatcgcaaccagtcttatataaatgaatacctgaacagcacagatgaaggatgaatatatataaacttcttgagaagttctgaacttcttgttgtaacgacccagccggtcgtttcgtttcccccatttttgcttcttattgctttgttcatctgtgttatatggtatcgggtttgtcggttcgaatccggaatggttttggtaaggtttgagacacttaatctctaaagttggcctttgagttggaaagtcaaccggatgttgatatatgtgaaagggctcgaatgtgaattccgatggttcggaatgcttcgagaggtgatttgggacttaggagcatgatccaaatgtgttttggaggtccggagtagatttaggcttgaattggtgaaattgaaattttggcgttttccggttgattggtgagattttgacataggggtcggaatggaatttcggaaatttgagtaggtctgttgtatcatttgtgacgtgtgtacaaaatttcaggcctttcggacaaggtttgataaaccttttgctcaaaagcggaattcagaagtttttggaaccttaggcttcaatccgatgttatttggttaattcaatgttgtatcaggtgtttcgaagattagtataattttgaatagtggtatatgacttgttcgtgcttttggttgagatcccggggacctcggggtaatttcggatggttgacaggaggtttgaagttggaatttgtagcttaagtgctaaaactcctgtcataaccgcacttgcaccttggggaccgcaggtgcgggctcacagaagcgcctagagggtcgcagatgcaaaaatgaccgtggggagctggattcacaaaagcggttgttcgagcgcacctgcgatagcgcaggtgcggtattatgatcgcaggtgcggtcctagtgccattaagtggtttccgcaggtgcgcacctagaaccgttggtgcgggtccataggtgcgagattttgtaccgcagaagtggtttagctggggcataacatatatatttggccctttgcgattttgagtgatttttcaccatatttcattcgggagaaagctttgaagagggaattcaagggaatttcatggaggtaaggtttttggaccctaaacttgtttctatgatggtgtttgactgattgagcttgaaatctatggaaattagtagcaaaaattgggtgtttagggcttgaaaattggagaccttaatctaaggatttgaggggtcatttggggttggattttgatattattgatatgtatgaattcgtgagagtgtaaggattctagtttaggcatggtgacgagcatatatacgtcggtgtcaagcaagcacatgagtcttgtagtgtaattgttgtgactccgttgttgtttattcatgcttcataagaagattatcattattgttcccttgccgggatgttgttgtgatattattgttcccttgccgggatgttgttgttatattattgtttccttgccgggatgttgttgttatattattttttccttgtcgggattcttttatgattggcgttgataaatgaaaagggagcgggctgcacgcctgcaacggtacaatatgaaatgggagcgagttatacgtggtcgtcaagtaataaagtggctaaaagtcagatgtcgatcccacgaggacttgtgattaactattaactaaattagactatcctaattatctaaacaagaattaaaactaaaattatttgattctaaactaattaaataatgaaatataaataatgaactttaaatagagaaagagcagatttttatgttatcaatgtaatgaaaacgatctagggtcatgggctatctaacaatcatattgtattcttctattgaattgactaactaatttatctagtttattggttgacagggttaatattgctcataagaatctgtcgagttcttactcgcctattcaagctaacctaacgcctatatgtctatggagttagaatcaacaagaacgcatttataattcctgtaaatcaaccaagcaaggcaattgagtatatgtctatcccaattgctaatccgttccccgaggcccaggttcaagaacttgccctactcaatcctatatgcaatctagaattcccactttcgagttcaactctagattcgtagatagtattcaattggtgatcaagcaatcaaataattaagcgcaagattgaataaataaaccaatatgataaactaagaaatcaaaatcaatatccgaataaccatagtcatgaaagaaccacaaccctagaacgtgaagtttagctccacatagacatggtagcaaaacaacaaatcatacaaagagacataaaaattacaaagtttggaggaagaaaagatgaaacccggcctccacggcggttctgagctcttccttcgtcaaaaattactctaaaaaacgttctctcatgtatatataccaagtagggttaggcccaaacaattataccttttccaatgtgacaaaggacctttttttcgggttttactagcgcgggcgcgcatctaggcgcgcacgttggctgacattctgtcctgggcgcgctaaaactagcgcggtcacgcatctagcgcgtttgaccctgttcctttccgaatttggaaaaatgtaaaacatgaaagttgtagccctttcagttagctttccaaccatatattatggagcccaattggagttctgagtaaaacgttatgtctattttacaacacagtgcgcaatctacccactggatgcttcgttcgctctaactatcatcctttgacccccaaacgcgatcccaatttaattccttgagcttttactcagatttcaaagctccaaatcatttgaattcattttataacatctatatagctcggaatcactcctacaaggcataaaacacagttagagcaagacactagcgattaaagcgcaaactcaatcaaagtgcagtaaatttgagtgtaataagtgactaaaatacacaattgtagcctatcatcaataccccacacttaaaccatttctcgtcctcgagcaatcaaactacactttatatatacacaacctttttttaaacaattctcctaactcatcacactaagaatatttaaaatagacgaagcacaaaagtgtaacatcttcacctcaagatttgactcacaagtaccacacattattcgtaactcacccactttctctaatatagagatcactgacattacctttccttcatgaatcaagtgccctcacacaacaaaagagagtagttccacacaataaaatttaaaaacacttaggaactcaagatagaaagaattcactcactctcagaaataacattcatatgccacaaaagatgcaccatatgcttgcccgtagtgtactactctactaatcgagctcattcagtctaggatcaagtaggactttatttggttgtaatgtaggctacgggacgtgtatgatacatttagatataatagcgactaaacctccctaagccctttaatacatacactttaacattcaaaatcccacacttatgtcaaaccataactccaccatcacatcaatatatattaactcccacttctttaagcacaattacatcaagagtcactactattacagaatattttcacatcaatacaactattttttttcaattcaagtggctcttgctctttcaaaacagtgcacctttctccttattcagttagttccactcaaaagccaaaccaaccacccctcactttaacttttacaaagttcataacaattcaagtgctcatgagaggtgaaaaggttcaaatatatggttaattcaaataaatgggtaaggcttgtaatgtggtttccaaaagaaacaggattacaggctcaaaggggttaactatgatacataacaattaggcgggtaaaatatttatatggctcaacaaagaaacgcctgtatcatttccaagactgaaaaaaactactatttcgctttgcaaacacacggggcaagttctagacatcaaatacaatgcacagaataacacaaaaccttacacacacatggcacataactcactcaggattggactcatccagacactctagtcaaagaagttaagcaaagttaagatcatacaatttaaggtacttatacaagagtaaaaaactgagcctaagcgtcacaactaaagtactcactattctcaaggcataacaaagtcaagagatattgcttcaatttaaagcacaacaccatgtcttctctccttaaaaaaaaataaaactacctatacccggttcaaataaaatccttggaaaagaaccgtggcccaaagaaaaaccaagggggagttactacactacctaaaacaaaacaaaaaaaaaaatctttttggtattttctttagactaaaatccctcaagaaaattgtctaaaggatccgtcatcaggaagagtctacatatttttcgattttttttcttttgaataattactacactatgaacgagactaaactaacatagcacagaaaatcacccagacaatctcttcaccccacacttaaaattgtgcaatgtccttaatgcacactaaaaataacaagagggtacaagaaactccctggtaggccaaaggccgaagtattagcagcttacgggatactcagacttctcccaggcacgatcctttgtgcgggtacctcacactcagtttcaaccgcctgctcgcttttgcactcgcctattggctttgactccattctcttactcctacaaaacaacaaaaaacaacactacaaatataacacaataaaaaaattaaaaaaaggaaaaaattaaaatcgggttgcctcccaacaagcgcttgatttaacgtcgcggcacgaaaccatcactttcaccacttttccttccactttgaggatataaattgcgcccccatttttgcatcaatttttctatcatgttcatgaggcggtggtgtgaaaataaaggaaccaagaaaataatatcgcatcttgcacttcttggcccttaagtgaggtatgtcatttcgtctccttggtatggcaaatttcagaatataagtactttgttcctcatccattgactcctccatatgctcgactggatcaattcccatatcaccaaccaaacaccacgttgaaaagtgtttagaatgaggtccaatacgctccaactccaaaattgcattacttttgacatcctcaattttgcgttcttcgtcaaccttggcatcattaataatattttggtcgaataattgaagttcctctttccgctccacaagctggccagtatccacaaaaattggttggagggcatcagacgcctcaacctttttattcaattgatcatgcaagttatggatatctaagccaaattggtctatctcttgcctgagctcagttcttgcttctattagttgttcggtcacattcgaaagaccatcacggagaaactcgtgagattttatcttttgagcttgttcctctagccaagattggcttactatatctgcttctccaaaacaatcttcttgtgggaactcactctcttcatcgaattgaggttcttcttagaaattggctatatatgcgtccattctagcctggagtcttttgatatcttttttgagttcatccttttgctctgctagttgcctcagaatatctctagtatatgcatcaggttccgtatcctgtacttcattgctcatatcaaactcataaacattattagaaacatcataataaaagctctgagaaggataataaaaattaggacaaccatcccaatggccatcttgaccaccacatatatgacaaatattccactcaaaggattaaaattgtgtgcacaactcgctccctggaacattctgacaatttttccacaagtgaggtcctccacaatatggacaaggatcatcataataagaataaccaatattcgaccaattctcattccaataagccatgtcaacaaatataataaaatataaaactaatataaaaataaaaagaaacttgaatagacaaaaagtaaaaatctaatctagtagactagttaatttctaagtccccggcaacggcgccaaaaacttgttgctcccaaacgcacacgcaagtatacgcggtcgtcaagtaataaagtgactacaagtcgaatgtcgatcccacgaggacttgtgattaactattaactaaattagactatcctaattatctaaacaagaattaaaactaaaagtatttgattctaaactaattaaataatgaaatataaataatgaactttgaatagagaaagagcagatttttatgttatcaatgtaatgaaaacgatctagggtcatgggctatctaacaatcatattgtatttttttattgaattgactaaataatttatctagtttattggttgacagggttaatactgctcataagaatctgtcgagttcttactcgcctattcaagctaacctaacgcctatatgtctatggagttagaatcaacaagaacgcatttataattcctgtaaatcaaccaagcaaggcaattgagtatatgtctatcccaattgctaatccgttccccgaggcccaggttcaagaacttgccctactcaatcctatatgcaatctagaattcccactttcgagttcaactctagattcgtagatagtattcaattggtgatcaagcaatcaaataattaagcacaagattgaataaataaaccaatatgataaactaagaaatcaaaatcaatatccgaatgtcaatagtcatgaaagaaccacaaccctagaacgtgaagtttagcttcacatagacatggtagcaaaacaacaaatcatacaaagaaacatgaaaattacaaagtttggaggaagaaaagatgaaacccggcctccacggcggctctgtgctcttccttcgtcaaaaattactctcaaaaacgttctctcatgtatatataccaagtagggttaggcccaaataattataccttctccaatgtgaaaaaggaaatttttttcgggttttactagcgcgggcgcgcatctggtcgcgcaccagggtgcgcacattggatgacattctgtcctgggcgcgctaaaactagcgcggtcgcgcatctggcacgttttaccctgatccgtttcgaatttggaaaaacgtaaaacatgaaagttgtaaacctttgagttagctttcgaaccatatattacggagcccaattagtattttgagcaaaaggttatgtctattttactagacagtgcacaatctgcccactggatgctttattcgctctaactatcatccgttgacccccaaacgcgatcccggtttaattccttgagattttactcagatttcaaagctataaatcatttgaattcattatataacatctatatagctcggaatcactcctacaaggcataaaacacacagttagtgcaagacagtagcgattaaagcgcaaactcaatcaaaatgcagtaaatttgagtgtaataagcgactaaaatacacaattctagcctatcatcaacgactgcaacgatactatatgaaatgggagcgggttgcatgcctgcaacagtactatataaaatgggagcgggttgcacgtctgcaacggtactatataaaatgggagcgggttgaacgcctgcaacggtactatatgtaatgggagcgggttgcacgcctgcaacggtattatatgaaatgggatcgggttgcaagcctgcaacggtattacatgtgtacttgtttcttatttccttatcttttgcgggtaattaatttatggcgttcctttcatttcgctattgttattatgttgttacctgttatcccctgcagcatgtttcccctgcccaactttagttgtaattatctaattttatttccgctgtatatgatttaactgcacaggtttatttagtagtatggtcctagccttgtcactattcaccgaggttaggctaggcacttaccagcacatggggttggttgtgctgatactacactctgcactgtgtgcagatattgataccagagcgcttgaaccgcagtgagggtgctgtcttcagtccatctaggcgacccgaggtagtcctgcagccgtctgcgggccttggcgtctcctcctatcttttctctttctgtttttacttattcagagacagacttgtgtatttccattcaaaccttatttgtagtattcttagatagtccgtgacttgtgacaccaaattctgtgtagtattgtacttcagattatgtagcaatgtttggttgaactattaagtttttcgtcttccgcatttctagttatttaatttattctgccgtttaatcacttatactttgaattgtctaacgcttaataataaggctaataattttataatattcggcttgcctagattccacgagtaggcgccatcaagactcccgagggtgggaaattcgggtcatgacagttggactcccacggactcagaggaagttcgatgcagtttgggttattgtggattagattgaccaagtcagcgcatttcattcctgtggcagtttcctattcttcagagcggttggcagagatttatatccatgagatcattcgtcttcgcggtgtgcccatgtctatcatttttcgatcgaggtacgtagtttatctcgcatttctggacggcaatatagcgtgagttgggtacaagggtcgagttgagcacaacatttcatcctcagacggacagacagtccgagcgtactattcagatcttggaggatatgctctgcgcctgtgttattacctttggaggttcttgagactgttagtggagtttgcctacaacaacaattatcattcgagcatctagatggctccctatgaggcattttatggtagatggtgtcgatcggtggttgggtggtttgagctaggggagattcagttattgggtacaaatttggaataggatgccttggataaggtcaagatcatttaggataaacttcgtatatcccagtccaggtagaggagttaggctgaccgcaaggtttgtgatgtgtcattcatggtcggatagagagtgttgcttcgggtatcacccatgaagggtgtgattcagtttagcaagaagggaaaattaagcccttatatcgggccttttgagatccgtgagcgagtgggagagtggcctacagacttgcgctgccaccaggtttatcagtggtacatccagtattccaggtgtccatgctttggaagtatcacgataatccatcctacgtgttagatttcagcactgtccagttggaccgggatttgacctacaaggaggaaccggtagcaattctagaccggcaggttcgtcagttgaggtcgaagagttacccttcggttcgagggcgaacaattattttagaggtggagaatgtgatgacccaaaacgtcatcttatgttttagaactcgattccgtattttgaggcctttaaaaccttattttattccttctcgattaacgtgcgcagtccgagcgcgtttccaaaaatcttttctatgaaaaattgatgaaataatattttttggcctaaaaagttgattttgattgacttcggtcaacgttctaagtaaatggatccgaacccatattttgacggtcctggtgggtccgtagtataatataggacctgggcatatgcccagaatcgaattctgaggtccctagcgagagaaatgaatttttgattaaaattgaaagactgaaattataatggtttaaagaaatttggtaatgtttgatcttgatggtatcagatccgtattttggttctagaacccggtacaggtccattatgatatttataccctatctgtgaaatttggtgattcaatggaactgaattgacgtgattcggacgtccagttatgagaataggaatctcaaagcgttctttagaattctatgtgattttgtgctaaattcgtagttctaggtgttatcttggcgatttgattgcacgagcaagttcgtatgatattttaagacttgtgtgcatgtttggtttagagctctgatgtaacgacccggctctaccccacacaggggcccacggcgtcgccggcactaccccctccaggggtagtcagccttaaggaattgttaccctcagccccagagtacacccctcacctctcaccaggtcccaggttcgatcccaagtggctgcagctgcggaggggtgtgctctggggctgagggtaacaattccttaaggctgactacccctggaaggggttgtgccggcgacgccgtgggaccctgtgtggggtagagccgggtcgttacatctgagggcttaggtgagtttcggataggctccggagtaatttggaacttagaaaaagttgctggtgttctaaagctatgttgcaggcctcagatctcgcaaatgcaaggtcaaggttcgcatttgcgactactgttgaggtcgcatttgtgagtttctcatcgcaatgcgaagagaagttgagccagcctatgttcgcaaatgcgaacaactcttcgcatttgcgaagttgatctgggaagggggtccttcgcaattgcgaacagttagttcgcatttgcgattgaagcagaaatgcgacaggttcacatttgtgatactttcctcgcatttgcgagtttcgcaatagcgaagttctggtcgcaaatgcgacatctgcagctgtgtaaaagggactgagacgggatttttcaatcattcttcaaattttcaaagcaagaaactctctaggcaattttccaaagactatttcttccccaaatcataggtaagtgattcctaactcgtttctttcaatctttcacttcattttacaagaattcaacgaaaaatctagggatttaatggtgaacagtgggggtttgggtagaactaggggtttttgtataatttgaatttagacctcgatttgaggtcggatttcaaaactaatgatatattcaggctcgggggtgaatgggtgaatggattttggtctgaatctcgagttttgaccaagcgggcatggggtcgatttttgacttttgagaaaaatgttggaaaacttataattatgtattggaatgaatttctttagcgataattgatgttattaaattaattattactagatacgagtggttcggaggtggaaactataggaaaaacggtaattgagcagtgagcggcatgtggatcgaggtaagtgacgtgtctaactttgactcgagggataaggaacccttgaattaattgctatgtgaaaatccatgcgagtggcatataggtgaggtgacgagtacctatgcgccgccaatttatctgttttacctggtttatcagtgttttatggtataatttggattggtctcgctgagtagtattaattgtgcaaagcttcataatgtactagcttttcgttttctttggttgaagtttaattattgtggagagttgagttaaattgtgaaatttctgtatttatttaatgattggtactgatatggtaggatctgattacgcgccgcaacaggaggaataagggtgatatattgaggaggaataagggtgacatgttaatgtcctgtgggatcgggttccacgccgcaacaagatgaataaggatggattaatatggagtaataagggtgaatatttaaatttatattgattaaatggtaggatcgggatgctcgccgcatcagtttatatttttatgtatttttcttctactgtttaagtcattcttgtgacgaaccggctagtcgtctcatgagttaccgctccgattttcccatttctgcttctttatgctttttttaatccgatttatgaggtattgggttggtccgatcgaatccggaatggttttggtaaggtttgagacaattagtctcttatgtgtgagtttaagttggaaaagtcaactggatgttgacttatgtgttagagggctcgaatgtgagtttcgatggttcggatagcttggaaggcaatttgggacttaggagcgtgatcggaatgagttttggaggttcggagtagatttagacttgaattggcgaagttgatattttggcgatttctgattgataggtgagattttgatataggggtcggaatgaaattctgagagttgcagtagtttcgttgtgtcagttgagatgtgtgtgcaaaatttcatgtcattcggacgtggtttggttggattttttttatcaaaagcgtaattcggaagattttggaatcttaggcttgaattcgatgtgattttggtgttttgttgttgttttgagcattctgaaggttggaacgggtttgaatatgtttatgggatatatttgtatttttggttgtggccccggggggcctcggggtaatttcggatggttgacggagagattggaagtttggtgaatgctgcatatttgttgtttctgttttttccgcacctgcggattggggaccgcaggtgagacaccgcagatgtggaagattggtcgcagaagaggaagacggtaaaggtggcaggaaccgcagaagcggtagaagaaccgcacctgcgatggcgcaagtgtaggttaagcatcgcagatgcggaagctgggacttaagtgaaaaactgcagaagcggttcaagaccgcaaatgcggtaccgcagaagcagggtttttgccgcagatgcgaaatccctgggccagattatatatatttcttccttcgcgattttcagagggtttcaccatttttaaacgagaattctggagttttgggaaattttgaagagagaattcaaggagacttcattgagttaaggattttggaccaaaaactcgtttttatgttgttatttcacggattagagatataatttacggaaatcaagggttaaaattgggaaaactaaggcttggtattggagacctagacttgagaatttgaggggctatttgtggtcggactttgaaacttttgatatgtatgaactcgtggggagataaggaatctattgatgtaaaaattatcgaatttcgagacgtgggcccggggatcgggttttggtaatttcgggatttgtattgtaaattgattattttcgcttggccttcattcccttagcatattttgacattgtgattctgattgtggatagattcgacgcgagtggaggccgattcgaggggcaaagtctaggtcgacgcgagtggaggctgaaaaagtctaggtcgacatttcttgtcttgtagtctattaaaattatggtattgtatgtacttttaagtttggattttctgaaaactagattgatattatatggaggttggtctcaaatgtatggtattctataattatcaatggttctgggaagggatttttcacatccagccaagacctcaaacgtaactaggagatcgtttgtctccttctctctttattatgagcgcggaagtactctccagacttcttaacaagcttcatgataatgacaaattcatccccatcactatgaacacccctggtactattattaattatcttgcatatgcagataacattttaattttcactgagggaaacaacaaatccatcaagcttattatgaaacaattgagaggatatgaaaaacttccggctagaaagtgaataatgataaaagttttttcatcacagctcctaacactgttgctactagaatcaataggatgaggaaaacatcaggctttatgaataaagacttcccctttaattatctcggttgtcctatatttcatgggattttttttttttttttgctactttgatggaatgattgccaaaattattataaaagattgatggttggcagggtaagatgctttcctacggggacagaatgactaatcaatagtgtgctccaatctatgcatatctacattttatctgctatgaatcctcccaaaggctccaattcggatttagtcaaattttaatacggatactaaatattgagcgaaaaccctttaaaaaaaactagcctctatacactttccactagttacatttttagtttgtgttttgtccttgctgcttcaacttgcaataaagtctaggtcgacatgtcttgtcttgtagtctattaacatgtgtggtactgtatgtacttttaattgtttaataagaacaaattaagtaatattaaaatgtccaataagagcaagcctattagttgaaatgtcaaaagttggtatgaaatttagggagttattatgctctcgttatagattttcgttactattttgtaagttaattttttttcaagttctaaaagttgatttatgatagtttttaggtgaaattttttctttcactcacaaaattttaatattttttttaaataaatgcatatctaaacacaacttcaactttcaaatattattttttaacataactttaaaaactctttttacaagttttaattaaatatatgttcaactatgtattcatttctgcttatgttttatcattcattttcataagtgaatttcatacctatcttcatgcaaacacttatactataaaagatatattattcctaaatacaacatgtgatacgagatcattacattataagtgtaacttattattggcaaaattacggttgtttgtctcctagttttgtgtctggtgttaaggtgtcccacatatggtattgggcaagagttggagtcactcggccaccaactatctgcatttgacccattgtttcccgttaaaacaattcgccccaagttgatctatttgtcaagtggccatgtaacgaccttgtttttggttatttggaaaatttctaggaaacccgcaatcgctatccttcatgtgcgcactgagtaattggctcacagtgcaattgctcgcaaatcacaccggagatataaaccgcattaggcacacctggtgcgatgagctttgactaagaaaactaatggtaaggcaaatcaaactcaggtctcccatatagaaaagggaaaccactcatccaatctttagtcaatcatgatgggcgtgacttcaaagtaataagtcttttgtgaaggctttccttttgtcatttttctcccttgttcagaacaagttgttctgaacgttgcacgagacattattaagtgttttataaataggggagaaacattatttcccttttcatagcaaaaaattgaaactccaaatagctcatcagaatgttttccaaaactaacctttttctttgcctttctttggctattttgctaatagtaatatcctcacaagctgatgcaagggagatgtcaaaggcgcctgctacaataacccaaggtttatttacttcctctatctattactccactataattgtttaaactatattgctagggcagggacacttcaatttaattatttatatgtctgaaacatgcattcttgcatattaggggtggacatagtctgggcaaacccgaaattcaaactaaaattcgaatttttttgaatttttggtttaaattttggatttaatttttaatttcttgggattttgcattggatattggatttgatacttcaaatatttgaatatccgaaaattcaaaatttttatactttatatttagtgcattatccatatgtcaatagcaataaattcaataccttatccattagatattatctcatatattcagtattaattactaatttactatcagaatactttctatttggacatagttttactattgttacttcttaccggccttattaatgtctttattatattttcttgataatgatttcattacttgaatactttatttggatgtagcagtgagaatgaggaactatttaggtaacttaacaagactactttatttagatgttcattttttaagaagaagaaacatctaaacttataggttcaaaaccgaaaatctgaatatctaatccgattaatccaaaaccgaacttaaaaaatctgacccaatccgagcttgtttggattggatttggattgtcatttatttaatccaaaaactgaatatccaaatcgaaattttcatattcaatccgaactgcccgaaccccactcctattacatacaaccatgattctttctttcgggccaagctcttaaaagtagttttcattttggatggtgacagacttgaatatccgaaaccttgttcctgccaattgtatgatcaataacaataataataaattcagtttaatcatataattagttaggtcaagcaaggatacaatgtaggtagatattacccttatcttgaaaagataaagggttatttttaatagatgcttagctcaagaaaagataaaaaaggagtagtaaaaagcattaacatcagcaagataataagataatcgaaatgaaagaaccagcaggtagttgataaaaatctgaaaataaaaatatacaagactaacatcgatttatattagtgtaaggacaagggaaatgcatgactacctattaaccttctactctatttcttgacctccactccctcttatcaagggtttatgtcttcggtaagctgcagcagcaccatgtcccgccattgtgtgatcatttcatttaaaacttaagttattagaggaggaacgcacgttcatcccaatttatttatgtctgcagcgctgagaattaatactaccacatttaaatttcctcctttattggttaacctataactaatacattactctacataacctaatttggtgcagcaatcaagatgggtgcaggaatcaacggcgtcggcaaaggcgtcggcaaagccgttggcaaagctgttggcaaagtcgccggcaaagcttgtaaaatttgctcatgtaaatacaagatttgcagcaaatgtcctaaatgtcaagactaaagttaggcctgagagactatgtacttgtgctggtgtgagtttagtttagagaataaagggaaagctatgaagagcctaatataattctattcactttaattgaataaaggaagttcaccactattgcatatggtactggtgttaatttctcttatattttgtgttttgttttgttagttcttattgttgcaacttgcaataagtcttgggtcaacatgtacttatgataaggtttatcatttttaaaattcgaaccttaagatatttcattaaattgagtatagaaataaccttatcaataatatatataccacgatcttgaacatactaatcttatgtataagcgattatatagtaattacttgatcccgaagacattataggagattaatctggaagagcaattagcccggtagaatgagagactgaaggaaatgtatgaattgttaatcacttttgctaatggattatgccatattcaatatttacagcagagattacatatagatactcaaaaatgaatccagcattccttttcaagctaattattagttttgcctagaacagtttaaagtaagtttgatttgaagactattgcgtaatcatatattagcctatatcatctgaagagctgatactatttcgtttatcaggaattcagctatttaactatctatatctatatctatatctatctatactatattaaaagcacgaaggcccttagcgaaatgtcgttcgccttttttacccattaaaaataaagttcacactgagtaaaatagtcatttcattattcttcctaatatttaggattaaaaatcggtaatactttaggagactaatttttctattattttcctaatatttaataattccaaatcaagtagattttgtttattaaatcttccttatttaaactatgtaataaaacaaatttgtaaaagaaaaataacaataaaagacaaccaaagtatttcagtaaaattaattacattcctttcacgttttgggagccttttgtttgtttaaatttcaaccaatcaattcattaaaaattaggataagaaaagcaaagtatttctattaaaatgattacattcgtttgaactccttttatattttgggagtcttttatttttgtaatcgttaaccagttaattataaaacaattaggttaagtctcttttagctctttcattccttttagatttaggaatcttttctttttgtttgttataaccaggggcggagccaccccttcggctgcgggttcggccgaacccagtaactttggttcaaaccttatatttgtcttaaaaaatatattgaatatatacaaattattaagttagaacccagtaactttaaagaaccagaatcccgaacccataagattcaaatcctggctccgcctccagttataacacgtgaaaaaatcacattgggatactttcgagcatgttgaactccttttaggtttaagaatatttttccaaaaaaatttgaccaattaatactttaagattatttaggtaaaaagttcattaatatttagtaattccaaatcaactagattttgtttattatattcttccatatttaaactaggtaatataacacatttgtaaaagaaaaataataataagagaaaatcaaagtatattgtaaagtatttcaataaaattgattacatccgtttgaactccttttacgtttgagaataattccttagaaatgtttaggttttttagcactttcaactccttttagatttaggagttttttttcaataacacgtgaaaaattcacattagaaaacttgtcgagcacgttggactccttttaggtttaggaatatttattaaaaagttaaccaattaatttaaaattatttgggtaaagagttcatggtaaatttgagcacttttaccatttttaggtttaggatcttttctttcgttttttttttaaatttagagcaccttcacctctttttaaatttaggattatttgtttatcaagaattcaacttctcctccaaagcattaagtcgttttgcgaaatatttattaaattttattggacaaaattgtagcttagttattttctaatatttaggaatttaatatcaaatataaattttgtcattaaatcttttcaaattcaaaaagtatgaacacacgcacacacacacaaaaaaaaaaaacggaaaaaccaaagttaacccctaaatgggagaaatcaaagtaggaaactaaatatcgtgcacctagaactctattatgtttaggattcttccttccaagtataatcgattttaattatttatttactaatactgcatgtatacatctaaacggtataattctgaagcaaagttgctatatcttttctgcaaaaaaaaaaaaaaaaaaggtatttattgttaggtctagaaataaattgtgattattagtctgttagatatatattagattagaaataatggcaatgaagaatatttaggaaagaattttaacgttgttatttcatgtggtcataattttgaagtacttcatataaaagatatatctgcaacttcttagaatttagaacttgcatactcgcgacattcatgctttatttttcaagttatttcctccaataagtataaaggtcatagaaggactagaatattattgcgagcaattaatataattaggctgccgagatcttttataccagaatcttcctttattaatttagctaaacaagatcaatattcttaatattttcaaacatttaaacctttttttaacattttaattttataacataatttttaatataaaattaatgttaaaaaatgttggttaaggtagaatcaagtagtttgttatatgcatatcaattttgaagaaaaatacacaatcatattatttgagaaatttgtactttacgataaattttcatgcttctttctcaaagcatttgccagatttcaccaaaaaaagaaaagaaaaaagcatttgccaaaaaaaaggggtgaaccaaagtttaaaattaatagctcaaaatgcaacttaaagttacatagtttttttttttttactcttcaatcatataatattatgcgtgaaaaatacaaatactcattctaatagatattattaggtataatttctccaatttttcaccataaccatactcttcaattaaatattatattttaaaaattcttatgatatgatacttaacgtaatacatcaagttcgaacacctaattttagagtagatgaagagattattgttacaatcttctataaattaatttctttacattaagtatattttactaatcaatctaagaaaacagataatcgtacaacttcagtaagttggaggcaaatccaaaaatcacatagaattgaattctctggtctgccactactctccatcttcatactaaggtaaaaccttataagaagaaaaatgaatatttatcaaatttttaatcgtaccctacttcaattaggactttttcataaccatcatgggtttgataagcttgaattatcctcaaattcaataatttctcttataagcttgcaatattcgagcttggcttttcaaattattttcttagagaagcataaaggttgtagaagagttggaatattattgtgaataacatgaatatacatcaacaccttgtgcttatctctagaggtttattcagcacatatggaaaagttataaatatgcatttgatgatttaaatatgacatgatttcttcttttattgagttaaataaatagaattggcatacattatttcaggaacttgtactatattataatttatatttagtaattaaaccatattatttaataatatttgtataatttttaaaattttgtgctcactgatattagggtacacgcgcaacgcgcgtaccctaagactagttatattaaaagcacgaaggcccctagtgaactgtcgttcgtcttttttaccctttaaaaataaagtttacattggataaaatagtaatttagttattttcctaatatatagaaatactcatttaattattttcctaatatgcaagaatactcatttaattattttcttaatatttaggactacaaaatcaactaaattttatatatcacattcttccttatttggattacatagaaaaatttaatatgtcgaacttcaaaaatattaaaattttattttatataattttttacaattaaattatatataaatggcaacaaaaagaaagaattaaaaatgctaaccaaataggacgtaaccacttggtatttagaagtttacccctttggatagataccaagaattcaatcaaaaaaagaaagaggacgtatggtgttcttgaaagatgacggagtaacttttttatgttttgatttaggtgaaactcttttatatactaaaatactttaaaatatacaaaactatttcccacccatttgattttcttacaatttgacaaaagaatttttattcaacaaaaagtattataatcaaatatttaaaatttgttgtgagctaatattaagaatttaaatcaataaaatataatttatattgtttattgctgaaaataaataattaagtatttggaatagctaattagcaaaaaaatttaatttcattatcttttaaattcatcatacaagtaaaactatcttcaggttgacaaaaatcttggcttaaatatatatgtttcaataaaaaagaccaccgatgatgaaaaaaattagaaaataaagtcgaatcggttataatattaatattaaaaactaatttggttaaaagccaaaatagaagaaataagaatgaaacaataagtattcaaaataagttgacatttactattatttttatttttcatctattctaattaatgaccctctataattttttctgtacgtaataagttattggttgtaaaatacacattcagtattagtcagttttagaccttacattttttcttaattattcctagaagctatatgacctagccgttcattccaatagctctaaaagaaagatacaatatttttaattaatgctaatttgatgactgttagaagaattataataaaaatatataacgatttagatcatgttagatttaatattatgacacaaaaaatgactacaatttttgtaagctttacccaaaggatacgcccttcaaattaatataaaatatatgtgctcaagttttttacgtgtgaagcagtttcttctaaaaactatatgacgaccctctttatttcaaatctctacaaaaatataattatttttactgatggcctcttgaagaatcataataaaaatatataataaatatcggaatttaattatcaataagcagatatgttgtaatgacccgacccgtcattttttatatttcagcacgttatccctgtcatatgtttccccgtgtgttgttatgtgtattcggggagttgggaatggtttggatggaaatcggataggaatgggttaaagagtccctttaagaggaacttgagttggaaaggtcaacccgacgttgacctatgggttagagggctcggaacgaatttccgatagctcgactagtttcgggggttaatttgtgactttgtagtgaaagaagaaatgaattcggagttccggagtgaaagttagctaggtttggcgaagttggaaattcggaagaatccggtcgataggtgagaaattgatccgagggtcggaataggattccgaaagttgcattagcgccgttaggtgattttgatgtgtctgcaaattttcaggtcatttggacgtcgtttggttggtttcggcatcggatatgaattttgaaagtttaagtctaagcttgaattgaattctatgattttgatgatttttggtgttaaaggtagcgttcttatgattcgaacaagtttgaatgaagtattaggttgagtttgtgcctttggttgaggtcccgggggcctcggggtgatttcggatggtttggcggattggttttggaccttgtggtgctgcagaaatgcagtcagctgttgcagaggagttatctctatgcgatcgcagggtccttatgcgatcgcatagaaggaattatggggggtggtcagttgagctatgcgaacgcacagcttgggtgcgaacgcattgaagaaacctggagggccatggggatgtgctatgcgaacgcactggccaagtgcgaacgcagagaggacctggggaaggctgaggagaagtactatgcgatcgcacagtgaggccgcgatcgcatagagataggacgcctgggcagattatgttttaagtcttgttttgttcgcgagccatgggttatttccaccatttttaagaaaccttgagagctcattgacggaatttgaaggggatttcatcgggagatcattggaggtaagtctcgtggtcataatacgcctttttattgaagaattaagcttaaaatctctgaaactgggtgaaattaatgaagaactagggcttgagttttggtactttaaatgatgatttggaggagcaattggactccgattttgataaattttatgtgtatggactcgtggcgagacgagggtcgttttggtttaaagttttttggttttcgagacgtgggcccgggactcgggttttgcgattttcgcaaattgtgatgtttttcgagttctttcaattgggttatgacccattagccttgtgtaacatattcgtcgtggttttggccagattcgacgctcgtagaggcggatttgaggaaaaagggtatttcgagctagtctacggccggctagaggtgagtaatgtcagcaaatgctgttctgagggtttggaaccccgaactttcacatcgtaacgctatattgaggcgtgacatgcactccatgataagtgcggggtcagatattgttggggattgagacttggtccatcccgagtgactcttatactatatgggcgtatgatacgcatactgtaatgattgttatgaggctttatgccgtgtttggggcctagcgccgacctgttaaatccttcgggagttatcatttactgtttagcatgacatgcatttcgtatactatcagtccatggtttttaaaacactgttctacaaacccagccgcattttctaagtttcaaaactcatatgtcatcttttaaatacatatcggctgagggtaactattctttaggctacatgtccgcggtgggccccagtggggtagatccggtgtggcagggccggcgacgccgtgggccccagtggggtagatccgggttgttataaatggtaacatggacacatgtgtgatatgatcggtcaggtaacatggactggcctggtattgatttcgccactcgatggctggttattgcgcttaggctgtaggagcccctccggagtctgtacacacccccagtgagcgccgtcgacgataaacgatatgggtggctcgggctgcacgccgcagtgggtactggattgtaccatcatttgcattgcatcgcatctctgcattgcatcatatatatattgtgtttagctgcttagttcagatattgtgatatcctgctttatagtctactttgtgttattcctgtattccttatctttagggctttatttcctgttattactcactgggtcggagtactcacattactccctgcaccttgtgtgcagatccagggcatactcaggcgggttagcttctggggttctcaggcgacagcatcggagtgttgaggtagctgcacggcattcgcaaccatcaactctccctctatccttatcttcagttttcattgtactttcagtttttgaacagatgtatcagatttatttcattatactctagaggctcggacttgtgacaccggttccttggtggcttatctttggttgttctgatttttccgcagttttcagtaattaaatctcgtatcttattaagtcattattgtttgagttcctttatttggggaaatgttggtattgtggtcaggcttgcctagcctcacggccgggcgccatcgcgatcgggatttggggtcgtgacaacttagtatcggagcctaggttacttggtctcgcgagtcatgagccggtttagtagagtctcgaagatcggtgtgtagacgtccacatcagacctttgagaggctgcagaacttttaagaaacacttcatattcttgaaattcttgtcatgcgattttgttgatccgagaactaaattctactattctattctctcgcagatggagagaacacgtgcttcccgaggtgcaggatgaccaccagtaccacctgctagaggccgtggacgaggccgtggacgtggtagaggcagagctacagaggcagcacctattgatccaccagctgcccaggttcaggatcagacaccagctgttgagactccagcagcacctgttcaggcaccggctgtgcctattgtgatttcgggtcttcaggaggccctggctcagattctatcggtttgcaccggcctagctcaggtcgtatcagcttttacagcagcagccacatctcagatagggggaggacatcagacccctgcagctcgcactccggagcaggttgttcaaggcttgcagacacctgaggaagcccatattgctccagttgctccagcagcaccggttgccccagttgcgccagttgcgccagttccacaggttgctccggttcaggaggttatggttccggctatgccagaggatgagcagcgtcgtcttgagaggtacagcagactttcgcctccgactttcagtggggctcagggcgaggatgcccagggatttctcgacaagagtcgacgcatgctccagactgtagggattttggagactagcggagtatcattcactaccttttagtttacgggtgcaacatttacatggtgggagtcatatgagcggcgtaggccagcaggagcagcaccgttatcttggcttgagttctccactctcttcttggagaagtgggtaccgcagtcgcagcgagaggagctgcgtaggcagtttgagtatcttcggcagggtgaaatgacagtgtcacagtatgagatgaggttttttgagttggctcgtcatgctccgtggatggtcccgactgatcgggagaggatcaggagatttgtggacgggtttatctatcctgttcgtattttaatgtccagagagagggttttaacccattcctttgaggatactgtcgacattgctagggacattgagacagatcgccgtctggagagagaggagagagaggccaagaggtctcgaggatcaggtagtttcagcagtgccccgtgtaggggtcagtttcagcagggtagaggtcgccctttcaggcagcagcagccggcccgtcccgagtatcacggggcatctccaggccatggtcatcagggttcacagcagggccagtcttcactgagtgcactccctgtcgacgcccccttttttcaactaaaaagagaagctgaaatcgggtttacgatattatgggcaaaacaactctcattcccgttaaggaattgggttatggaattagaagagtcgccacctaatgattatagtgcattaggacacttaaaaaataaggagtgcttttagatgaagaccagagttcgggtaagggcttgagattatctcgaggggaaggtgttaggcacccctcaagatccacaagtgtggttcccggccatgctaattgtgactttagaaagagatgaagcaagtaaacaaatgaagtatacatgtatatcattcacatgatttgaaagctttaaagagaagtaaggacatgagttggaaatagaagaggattagttttgaaaagcactaagagagaaaccatttaaataaagcacataaaagaaaaaatgggtcctaggtttgactataatatggatcatttggtgcaatacccagcaatcattctcacacgagatattagcgcaccgtcatcatctccatattctaccctcccaccctgttaaggtattaaagcgcgttggtatcgtttacttattgcatgttaatacccgtcccaacctgttagtcccggggtattaggacttctaatcctaagaaagggggaagaggaaataggatatatatggagtgttcaaaggtgaaaaaagctagaacggcagtcaaaaacaagtagcaaataagaaggatgcacataaacaatttaggctcaaataaaccccataacatacgacaagtagtttagcatgacttcaattactaattggtctttaaaagaggttaggggagcgggcatattagtttaacccataggagttggatagaaaatctgcttcgagctcctcgggcccgttttgggaaactgacagactttaaaaaatcagtaagactttaaagaaaagatgataattgcggacatgagtcgacttaaaatacttggagttgcagacaagttttacaaaagaaaacacgagtttcagataggagatttaaaactgcggacgagtttgaggaaaagatctgcaaattagttgtataaattgattgaaaattagttgaaagtaaatagatttaggataagttgaaaactggattgttagaaaatattaacggtctaaacttaatctgttaacctttgagttgttgtttttatatcacttagacgtcctattatttgcctagcgtttatacatatctcctataggcatgctttctaggtgagaatatgaaatgcaacctaatagcatggtttctatatgagttgatgcaataacgaaagtacctgtagtgtatgtataatattgatgcaatatctatgaacctaatgactatatgagatgattgaaataaagcatgtatgctatatgagatcgatgtaatgatgtaaattcctataggcatgagttctatatgagtgcagaaagtaaacccctcccatgtcccttttactatatgccccgagttctttaatacagattattacaaaactgggcaaaagaggaaatgacattaaaggactaaaagttaaaatacatcaataactataacagacccgaggaagctagaagcaacttttaatatccaacatgagcctttaaaccaagtccaagctcccaagatccgaggcctttctctttcagagtattacaaagttccaagggctttcaaaggaaccccggcaatgcttatactctaaattaattagagtggtgcaagtgtggaattaccagccctaaggcgtccaagttcaaaggagactccaaggtccctaagcatggcgtaccaaaggggggtggaacttaaagaactaggaataagtgcaaatgtgcagggtttagaggaaaaccaatgcgaggggtggtcatgcccagccatagaggagactggcacaccccaaaccctttgcatgatttagcaagcaagagaagactttgaacaaagtcagactaaggcctgcatggtgattaggacaccaacagacctatgtcaaagctcaacacatagtataggggaatagggaatgggatcactttgagtataggttaagaataaaccatagttctagactagaagtggtattgatgtaccatcctagtccaaaatactactcacatgcaaacaaggggtagggaatgggaaatcacataaggatgatcaaaagcaaacaaacacaaggcacattgaagattcagaggtattagagcataatagtgaacaatacacaagccaggggacaaaggtaagggattaacatgctgagataaacagctaaagggagtaaagggatagggaatcaaaggctgaattaaaacataacagtcagagaaatagaaaagattaaactgtactggaaatttaaaagcaatactgaagtaaatcaaatagaggagtaaaggggtaagggactgatatcataatatcctaaggaacatggggaagaattaattaaaattgaaaaacatagcagtcaagaaacaagaagaaagtaaacaagtagttggataattgcaattgaaattggaacctaccagtgcaacttagagaacaaagcagatagaaaactcctgttggcttcaattggccaaatctcagcaaagaaagcaagtagcaagtagcaagaaagaatagagaatttttagtgagaagagagctcgagggatgagttctgagttgtgtgtttgtgagagaagagagtgtccatttatagtttgagaataggcaagcaaataaggcaagattatttcagtaccaattagaatcatgcagaagagaggaattccttcaattaaggagttcgagtttgaataggagaggactgagttatattttaggaaagaaaatcaataacacatggtgcaatcaggggtaaatacacgagaggatcttttaaaagctacattgttaggtaaataaggtaaaggctaaatcaattattacctagtaaatcagggattcaaagattttacattcatgaacttagtcagagaacagggcataatcagaaaatcatatagctgtaccacattaactaaggtttcggggaaaggggaggaacatcactataaaagaatcataaggttgaacatgcaaagactaggcacactagactagcagaacacatacgaaaaggtaatcaggcaaactagggtttcacagggaaaggtgaaaatactctttaaaaaattagggttctaccacaagtgagaacacataggctagcacaaatggagaggaacaagaatagaatacaaaggaggcatagagcaaattaaacgaaaaccccagaagggtatcagtatagaaaacacaaatagccacttaggagtttcagtgaagcaaaatagtggaagaaaacatagtaaaacgagtagaaatcacagtaaacaagcaaaaattaaagaaaccctaagtctttaagaagacgaacagttttctcttgaaaacacaaaacatgctaagaacgagatgagatacttagaaccttttagaaaacaaataagctcagagaaataacacacaaaaataagaagaagaacctcgaatcgattaggggtttttcataaaagcttcgaaaaatggagagaaaagcctcacggctcatcggagcttggcaaaggcctcaaaacttcgaagactcgccggagaagatccagccacggccatgagagcctcgttacaggacctctggctcattaaatctcaacacaacctccgatctttgaaccccaaggtcagggacgatggtaaataacgagtgtgagaatatccggccatgagatggccatggaagccggcgaagagagcagtgatcgattagggttagagagagtttagagagcattaggattcaagggcggcggacttgagtgaatggttagggttgggggggtttgggtaattaattaggtaagtaatgatttggacagttgatctaaaagatcaacggtcgagattaaaggggagatccaggcgggttaaaatccatgggcttgggtcgtggttacatgatatgtgtatttaaaattgggctgatggtggggttaaatgtggccaaaattgaaatgaaaaaaggctattatttaaatatcagatttccctcaaaatataattttaaaaattagtaaatagtctctaaaaaatgcaataaaattattgaagtactaaaataagtttagaaatttaataaaaatactaagaacgaatttgtgaaacgaaatactatttaatcgagaaaaagggctaagattgcaattctgtgcaattttgaagttaaaatacttaatgactttgtaaaaaatcctgtaaaatcacataaattatatttgtgtataaaatagagaataaaataatctcttcactaaaatgacaaggtttgataccagatattaatttttgtagtgtaaaaataagctgtaaattaactttaaaaggcttaaaaattatagaaaaataccaaacttcttgtggatgcttatatatgcattcacaagctatttttaaagatattttggacaaaagtacatgagggaaaaattgggtatcaacagctgcccctctttacccgaggaggatgaaagagttgtcgggtaaagacaagatggccaattttgaccggagacggtgacgataagggagtcaaggttcggcaaggattcggagatcggatgagctgcggaggaccggagcgggatcgctcctatcgaaatggctgtgccaaccggcgtacctgcaaatagaagatatgcgtgtatattgcataatttagacgtgatgcaagttcccattggaccatgaatgctgtcttcggacgatcaggatggcgtcctcagactatgacgtccgggcaatgaagagcaggaaagtaaagattcgcaggccatgaaatgatgttctcgggctacgcgggtggtgcctccgaactatgacgcctttgaataggttggcgatatttcatccgaatgaatgcagagagtggcgatctttcagccgagcaggaatattaaatgcaaagtggcgatatttcagccgaatgcgaaagtagacgaggcagagcttagcctcggaaggcagagaatagccttatgcaatgcaggagatggagacagagcttagtctcgaaaggccgcttatagccttatgcaggatggaggcagagcttagcctcggaaggccgcgtatagccttatgcagtgcagaaaataaaggaggtataacttaacctcggaaggccgcgtatagccttatgcagtgcaaaaaataaaggaggtagagcttaaccttggaaggccgcgtatagccttatgcaagaatggagacagagcttagtatcggaaggccgcgtatagccttatgcagtgcagaaaatagaggaggtagagcttaacctcggaaggccgcgtatagccttatgcaatgcgaaaaataaaggaggtagagcttaacctcggaaggccgcgtatagccttatgcaagaatggagagagagcttagtctcggaaggccgcgtatagccttatgcatgatggaggcagagcttagcctcggaaggcagagaatagccttatgcaatgcaaaacataaaggaggtagagcttaacctcggaaagccgcgtatagccttatgcaatgcgaaaaataaaggaggtggtgattttcttagctggtagatgatcgtgacatattgactaccggggaaatgttgagtatagacagtaatcctttgcggagtgagtacattgcttcgagagtctgttttcgggaaatgattgtgtcgttcggctagcgcctcggatacctgcatccaaagaaaaatcatgagttctgcggaggggaggttagttcgtatccctcggctcgtggcgtcttgtaccatttgggggcagcgttgctgaacgacagtgatccagataattttacgaaaaattaaatagatttaaggtaagtatgacacaaatgtatatatataagtaaggaaaggatttttgttttatgatgaaccgacaaactgcaacgtggtccgagtcacggcaaccttgctggttccggaattttgagggtcctcctcaaaattctgccccagtttactgggctggcgatgctgacggtgatactgtatgactgaaaactgaccggcctgccccagtttactgagttgatgctgacgcggcgatctgaaagactaacttcggaattttgagggtcctcctcaaaattctgccccagttctgaatgcgggaaaaaatggaattttgttagagatatgaccgaacccatagggctgcctacgtatcccctcttaaacgggaattaggtcaggtgtagttcaaattacaatataaggaagcatagtgactaaatgtagtatctctttacggcatctgagttgatgggtttcggccaaacttctccgtccatttctgcaagaatgagggctcatccagttaggacccggtgaaccatgtatgggccttgccagtttggagagaatttccctttggcttcatcttgatgtgggaatatcttctttaacaccagctgtcctggtgtgaacttcctgggtcggactcttttgttgaaggctctggtcatcctgttctgatacaattgaccgtgacacactgcgttcattctctttccgtctataagggctaactgctcgtagcgacctttgacccattctgcgtcatctaactctgcttcttgtatgatccttaacgatgggattttaacttcagcgggaatgactgcttccgtaccgtagaacaacatgtaggggttggccccggtagacgtgcgaactgtagtacggtaacccaacagagcaaaagacagttttttgtgccactgcttgtgcttttcaatcattttcctcagtatcttcttgatattcttgtttgctacttccacagccccattcatctgtggcctataagttgtagaattcctgtgcctgatcttgaaagtttcgcacattgtcctcatcaagtcactgttgagattggaaccattgtcggtgatgattgattccggaattccgaaccgacagacgatacggtcgcgaacaaaatttgccacgactttcttggtcacagccttatgtgacactgcttctacccatttagtgaagtaatcaatcgctaccaagatgaacctgtgtccgtttgatgcggctggctcgattggtccgataacatccattccccaggcgataaatggccacggtgagcttgttgcagtaagctcattcgggggtaccttgatcatgtctgcatgtatctgacagcggtggcattttcggacatattggatgcagtccgtctccatggtcatccaaaagtaacctgctcaaagtatcttttcgccaaaacaaaaccattcatatgcggtccgcaagttcctgaatgcacttcccctaataacctggttgcttctgttgcatcgacacacctcaatagtcccaaatcgggagtcctcctatacaggattcctccactgtgaaagaagttattggacaatctccgcaatgtgcgcttctgggtggcactagcaagttcgggatactctccagttgtcagatattctttgatgtcatggaaccatggttttccatcggcctattcctcgacatgagcacagtaagctggttgattgtgaatcgggacccagatggggtcgatgaaatttgtatctggatgctggatcatggatgatatggtagctagtgcatccgcaaattcattctgcattctcggaacatgttggaactctgtctttctgaatctcttcttcaactcctggatatgatgcaaatacgggagtatcttggaattctaggtagcccattcctcgcggacctggcgtatgagtaggtctgaatctccgatgatcaataactcctgaatgttcatgtcaatggccaatttgagccccaagatacaggcttcgtattcggccatgttgttggtgcatgggaacctgagtttggcggttaccgggtagtgctgacctgtttctgataccaaaaccgctcctataccaactcctttgaaattcacggctccgtcgaaaaacatcctccaaccatcgtaggattctgcaatgtcctctcctacgaaattcacctcttcgtcgggaaagtacattttcaggggttcgtactctcctcctacgggatttttggcaagatgatctgccaatgcctgtcctttaactgccttctgagtaacgtaaacaatgtcgaattcacttaacaggatttgccacttggcgagcttgctagtgggcatgggcttcagaaaaatatacttcagcggatccatccttgatatgagataactagtgtaggcacagaaatagtgcctcaatttttgagctacccaagtcaaagcacaacaagtgcgttccaacaaggaataccgagcctcgtacggggtaaacttcttgctgagataatagatagcttgttcttttcttcccgttttgtcgtgttgtcccaaaacacaaccaaatgctccatccagaactgcgagataaagcaataagggcctcccgggttcaggcggaaccaggactggaggcgtagacaagtattccttgatcctgtcaaaagccttttgacattcatcggtccattcagtggcggcgtccttcttcagcatcttgaagatgggttcacaaatgacggtagattgagctatgaaccggctgatgtaatttagtcttcctagaaaactcatcacatctttcttgtttttcggaggcggcaactcttgaatagatttgaccttggatgggtccagctctattcctcgacgacttacaataaaacccaacaactttccagcagggaccccgaatgcacacttggcgggattcagtttcaaattatacctcctcagtctgttaaagaatttccggagatcctccatgtgatctgcaacttttctggacttgatgataacgtcatccacatacacctcgatctctttgtgtatcatgtcatggaaaatggtagtcatggccctcatgtaagtagctccggcgtttttcaacccgaacggcatcattctgtaacaatacattccccatggcatgatgaacgccgttttctctacatcttcctcatccatccatatctggtgatatccagcgaagcaatcgacaaatgactgcaactcgtgtttggcacagttgtcgatcaaaatgtgtatgtttggcaaggggaagtcgtctttgggactggcccggttgagatcccggtagtcgacacagactctgactttcccatccttctttggcactggcacaatgttggctaaccaagtcggatactcaaccacctgaagaactctggctttgacctgtttggtgacctcttctttgattttcaaactcatgtctgatttgaactttctgagcttctgttctaccggcagacaggctggatcggttggcaacttgtgggcgacgatagacgtactgagaccggtcatatcgtcgtaggaccatgcaaatatatcctcatattccttcaagaactctgtgtattctttcttttctgccgatgataagtgcacactgatgcgcgtttcttttacattatccgcatcccccaaattgacaacctcggtttcatctaagttggacttaggcttgttttcaaaattctcaacctctcggacaacctcttctggtatctcatcctcttctgaatctatatccgtttgttgcatagtctcgttgcaagttacagtcgttggttcatcatcaagatatgtaatagtaatgctgtgtaaataaagtaaatagcaaagaaattaataagcgacaagatatttgataaatcggaaaagtgcttttgattgaaattcataaatgtttaaacatcggagctcttttggaaagtaaagacattgcggaaattaaagaaagcgattaaaacaaaatgcatggtgttcgttcagccttgctaccccggggatctccgggcaacggtggttctgattgaccagttggtgaggtgctcccctcgattcacagcccgaatgtaagggcattactccccttcctcttcgaaaatcacgcaaggaggaggaggacccttagatcttattgagtaagttgatggtgccagagcgcacgaactaacctttggggaggggaataatcaaaagaaaaacaaaaaggtaagaagttagtgcggattttgagaaaagaaatattgcagtatttaagcacatagttgcaggaatagaaatcgtttcctatttgggtgcctcgttgtgcccgaggtaggcctagcgacagatagaatttggagaacttataacaccaagtgcctcattttattgataaaaaatagaacgagtcaaaaacaaactgaaataaagagaaattgttactaatggctagtggccttgttacatcaagaaagcggtaaaatcctaactatttggtcccagaaggaccttcctcagatccgatattcttgcttccttcgtacagctgcaccacctcgcgaagtcccagtagcagattcaatgattttgttgtctggcctaacttcgaggagtgagggaaggtttcctaagtgcttgcgaaccataactcgatcactaccatgcagatcataccaccaacttagtaacctgggatggatgtttgacaccataccgaatctggggacctcgtgcctcatttctgtaaaaaagatggttaggccctaaccccaccagactcgactatttaaatcaacaattagcaacaggcatttagttctccaaatcgatgcacataacgtgaaggggtccgtttgggtttcaagaaaatccggtggacatttggtttaggctatcttaatgagtcattatgcggacgacataactgactcgactaagtttgactaaatgatgcatgaacagtttaacagagtaaggtttctacttttgaagtgctagaccaggtacccttgagcggacaactcaagagggaaaggcgcggaaccgtcgactacaccgttgatcgactggttttaccgcaagtatgcctttgccaaattcagggggtaataatatcggaagagcgcaaccactcattataagcgttgctataggattttgttggcacgagtggaatatgatgttgaaagatgcagttacaagtaaatacatgtattttcacgttcatacaataatgattacaataaaaaatgcggtatttaaagacataattgaagaaatgtaaaggcagtaaagcagttaaggaaaagaaaagacaatgaagaaataagtcagtaagtggaagaaatgattaaagcaataaatgtaataaaagaaagcagtaaggtcacaaatgcatgtaatggtgaaagccttaaaagaaatccccagcagagtcgccatgctgtcgacgccccctttttcaactaaaaagagaagctgaaatcgggtttagaacattatgggcaaaacaactctcattcccgttaaggaattgggttatggaattagaagagtcgccacctaatgattatagtgcattaggacacttaaaaaataaggagtgcttttagatgaaaaccagagttcgggtaagggcttgagattatctcgaggggaaggtgttaggcacccctcaagatccacaagtgtggttcccggccatgctaattgtaactttagaaagagatgaagcaagtaaacaaatgaagtatacatgtatatcattcacatgatttgaaagctttaaagagaagtaaggacatgagttggaaatagaagaggattagttttgaaaagcactaagagagaaagcatttaaataaagcacataaaagagaaaatgggtcctaggtttgactataatatggatcatttggtgcaatacccagcaataattctcacacgagatattagcgcaccgtcatcatctccatattctaccctccccaccccgttaaggtattaaagcgcgttggtatcgtttacttattgcatgctaatacccgtcccaacctgttagtcccggggtattaggacttctaatcctaagaaagggggaagaggaaataggatatatatggagtgttcaaaggtgaaaaaagctagaacggcagtcaaaaacaagtagcaaataagaaggatgcacataaacaatttaggctcaaataaaccccataacatacgacaagtagtttagcatgacttcaattactaattggtctttaaaagaggttaggggagcgggcagattagtttaacccataggagttggatagaaaatctgcttcgagctcctcgggcccgttttgggaaattgacagactttaaaaaatcagtaagactttaaagaaaagatgataattgcggacaggagtcgacttaaaatacttggagttgcagacaagttttacaaaagaaaacacgagtttcagataggagatttaaaactgcggacgagtttgaggaaaagatctgcaaattagttgtataaattgattgaaaagaagtttgaaacactttgaaacacagtaaatagttacaggttcagtatataaggtagcttatagattcagagttctacgaaaggggagcagacctgggctcgtttgaaagtaaatagatttaggataagttgaaaactggattgttagaaaatattaacggtctaaacttaatctgttaacctttgagttgttgtttttatatcacttagacgtcctattattttcctagcgtttatacatatctcctatagacatgctttctaggtgagaatatgaaatgcaacctaatagcatgggttctatatgagttgatgcaataacgaaagtacctgtagtgtatgtataatattgatgcaatatctatgaacctaatgactatatgagatgattgaaataaagcatgtatgctatatgagatcgatgtaatgatgtaaattcctataggcatgagttctatatgagtgcagaaagtaaacccctcccatgtcccttttactatatgccccgagttctttaatacagattattacaaaactgggcaaaagaggaaatgacattaaaggactaaaagttaaaatacatcaataactataacagacccgaggaagctagaagcaacttttaatatccaacatgagcctttaaaccaagtccaagctcccaagatccgaggcctttctctttcagagtattacaaagttccaaggtctttcaaaggaaccccggcaatgcttatactctaaattaattagaatggtgcaagtgtggaattaccagccctaaggcgttcaagttcaaaggagactccaaggtccctaagcatggcgtaccaaaggggggtggaacttaaagaactaggaataagtgcaaatgtgcagggtagaggaaaaccaatgcgaggggtggtcatgcccagccatagaggagactggcacaccccaaaccctttgcatggtttagcaagcaagagcagactttgaacaaagtcagactaaggcctgtgtggtgattaggacaccaacagacctatgtcaaagctcaacacatagtataggggaatagggaatgggatcactttgagtataggttaagaataaaccatagttctagactagaagtggtattgatgtaccatcctagtccaaaacactactcacatgcaaacaaggggtagggaatgggaaatcacataaggatgatcaaaagcaaacaaacacaaggcacattgaagattcagaggtattagagcataatagtgaacaatacacaagccaggggacaaaggtaagggattaaaatgctgagataaacagctaaagggagtaaagggatagggaatcaaaggctgaattaaaacataacagtcagagaaatagaaaagattaaactgtactagaaatttaaaatcaatactgaagtaaatcaaatagaggagtaaaggggtaagggactgatatcataatatcctaaggaacatggggaagaattaattaaaattgaaaaacatagcagtcaggaaacaagaagaaagtaaacaagtagttggataattgcaattgaaattggaacctaccagtgcaacttagagaacaaagcagatagaaaactcctgttggcttcaattggccaaatctcagcaaagaaagcaagtagcaagtagcaagaaagaatagagaatttttagtgagaagagagctcgagggatgagttctgagttgtgtgtttgtgagagaagagagtgtccatttatagtttgagaataggcaagcaaataaggcaagattatttcagtaccaattagaatcatgcagaagagaggaattccttcaattaaggagttcgagtttgaataggagaggacagagttatattttaggaaagaaaatcaataacacatggtgcaatcaggggtaaatacacgagaggatcttttaaaagctacattgttaggtaaataaggtaaaggctaaatcaattattacctagtaaatcagggattcaaagattttacattcatgaacttagtcagagaacagggcataatcagaaaatcatatagctgtaccacattaactaaggtttcggggaaaggggaggaacatcactataaaagaatcataaggttgaacatgcaaagactaggcacactagactagcagaacacatacgaaaaggtaatcaggcaaactagggtttcacagggaaaggtgaaaatactctttaaaaaattagggttctaccacaagtgagaacacataggctagcacaaatggagaggaacaagaatagaatacaaaggaggcataaagcaaattaaacgaaaaccccagaagggtatcagtatagaaaacacaattagccacttaggagtttcagtgaagcaaaatagtggaagaaaacatagtaaaacgagtagaaatcacagtaaacaagcaaaaattatagaaaccctaagtctttaagaagacgaacagttttctcttgaaaacacaaaacatgctaagaacgagatgagatacttagaaccttttagaaaacaaataagctcagagaaataacacacaaaaataagaagaagaacctcgaatcgattaggggtttttcataaaagcttcgaaaaatggagagaaaagcctcacggctcatcggagcttggcaaaggccccaaaacttcgaagactcgccggagaagatccagccacggccatgagagcctcgttacaggacctctggctcattaaatctcaacacaacctccgatctttgaaccccaaggtcagggacgatggtaaataacgagtgtgagaatatccggccatgagatggccatagaagccggcgaagagagcatggatcgattagggttagagagagtttagagagcattaggattcaagggcggcggacttgagtgaatggttagggttagggggggtttgggtaattaattaggtaagtaatgatttggaccgttgatctaaaagatcaacggtcgagattaaaggggagatccgggcgggttaaaatcaatgggcttgggtcaggtggttacatgatatgggtatttaaaattgggctgatggtggggttaaatgtggccaaaatttaaatgaaaaaaggctattatttaaatatcagatttccctcaaaatataattttaaaaattagtaaatagtctctaaaaaatgcaataaaattattcaagtactaaaataaatttaggaatttaataaaaatactaagaacgaatttgtgaaacgaaatactatttaatcgagaaaaagggctaagattgcaattctgtgcaattttgaagttaaaatacttaatgactttgtaaaaaatcctgtaaaatcacataaattatatttgtgtataaattagagaataaaataatctctttactaaaatggcaaggtttgataccagatattgatttttgtagtgtaaaaataagttgtaaattaactttaaaaggcttaaaagttatagaaaaataccaaacttcttgtggatgcttatatatgcattcaaaagctatttttaaagatattttggacaaaagtacatgagggaaaaattgggtatcaacactccctgcacagggttcctcctatgctccttcagctcagggttcatcagcgccgagtggatcggcgggtcattctggtgcgatgggttcccttcagtcacccttctccaactctaggcagttgctttgagtgcagtgagtttggtcacattaagaggtattgtcccagactccgtggtggtagatcttattctcagcagagggaccagccctcatcttctgcaccagtttcttctgctccccctcagccagctaggggaggtagtcaggtagctagaggccgaccctgaggtggaggccgttttggcggtgggcaggccaggttttatgctatacccgatagggccgacgtcgtcgcatctggtgctgttatcacgggtattattccagtctgtcacagagatgcctctgttttattgtatctgggatccacctattcttatgtgtcatgctattttgcccatcatctgggtgtggtacgtgattatcttgtttcacctgtgcatgtatctaccccggtgggtgatactatccttgtggatcatgtgtatcgatcctgtgtgatcatgtttgggggtctggagacccgtgttgacttgttgctattaggcatggtggatttcgatgtgattctgggtatggactggttgtctccgtatcatgctcttttgtactgtcatgctaagacagttactttggctattccgggtattcctagagttgagtggcggggtgtgacggattatgtacctagtagggtgatttccttcctaaaggcccagcggatggtagggaaagggtgtttgtcgtacttggcctttgttagagatgttggagctgagactcctagccttgattcagttcccgttgtgagggacttccccgatgtgtttccagcagacctgccgggcatgccgccggacagggacattgattttgggattgacttggtgccgggcactcagcccatttctattgcaccttatcgcatggcccctgcagagcttaaggaattgaaagatcagcttcaggaactcctagaaaaggggtttatccgtcctagtgtgtcaccgtggggtgcacctgtattatttgtgaagaagaaggatgtcaccatgaagatgtgtattgattaccgacagttgaacaaagtgaccgtgaagaataagtatcctttgcctcgaattgaggatttgtttgaccagcttcaggaactaaggttttctccaagattgatcttcgttcgggctatcttcagctgaagattcgggattctgatattatgaagacagctttcaggatgagatatgggcattatgagttcttggttatgtcgtttgggctgaccaatgccccagctacattcatgcacttgatgaatagtgtgtttcagccgtatctggattcctttgtgattgtgtttattgatgacatcctggtgtactctcgtagccaggaggagcacgcgcagcatttgagagttgtcttgcagaggctgagagaggagaagctttatgctaagttctccaagtgtgaattctggcttagttctgtggcattcttggggcacgtggtgtccagtgatgggattctggtagacccgaagaaagtggaagcagtgtagagttggcctagaccgtcttcggccacggagattcggagtttccttggtttggcagggtattatcgcaggttcgtggagggtttctcatctatcacgtctccattgactaaattgacacagaagaatgctccatttgtttggtctgatgagtgcgaagagagcttccagaagctcaagtcagcattgactacggctccagtgttagtattgccagtagcttcaggttcttatacggtgtattgtgatgcatcgaggattggtattggatgtgttcttatgcaggagggtagggtgattgcatatgcttctcggcagttgaagccacgtgagaagaactacccttatcttgatttagagttggcagctattgtgcacgctttgaagatttggaggcactatctctatggtgtatcttgtgaggtgtatacagatcatcgcagccttcagcacttgtttaagcagaaagatctgaatttgaggtagcggaggtggcttgagttgctcaaagattatgatattaccatattgtatcacccggggaaggccaatgtagtggccgatgccttgagtcggaaggcggttagcatgggcagtttggcgttcattccagttggggagagaccccttgccgttgatgttcaggccttagctaatcggatggttcggttggatatttcggagcctagccgggtgttggctagcgtggtttctcagtcttctttgtatgaccgaattagagaacatcagtatcatgatcggcatttgcaggttcttagagatcgggtccagcggagcgatgccaaggatgtgactattgacagtgatgttgttctgaggatgcagggccgtgtttgtgtgcccgatgtagatgggattcgagagatgatattggcagaggctcacagctcgcgatactccattcatccgggtgtcgcgaagatgtatcaggatttgagacagctctactggtggagaagaatgaaaaaggatattgtgggttatgtggctcggtatctcaattgtcagcaggtgaagtccgagcatcagagacctggtggtttgcttcagcagatggttattcccgagtgaaaatgggaaaggatcacgatggattttgtgactggtctccctcggacagcgaggaagtttgattctatatgggtgattgtggatcggctgaccaagtccgcgcacttcattccggtatgtacttcgtattcggcgcagcagttggcagagttctttattcgtgagattgtccgattgcatggtgttccggtttctattgtatcggacaggggtccccagtttacttctcagttttggagggcttttcatcaggagatggggactcaagtgcatttgagttcagcatttcatccccagacggacggacagtccgagtgtaccattcagattttggaggatatgttgcgtgcatgtgtgattgacttcggtggttcttgggaggatttcttgccccttgcagagtttgcttacaataatatctaccagtcgagtattcagatggcgccatatgaggctttatatgggagacggtgtaggtctccggtcggttggttcgagcccggcgaggctagattattggggacagaggtggttcaggatgctttggagaaggtgaaggtgattcaggagtgacttcatacagctcagtcgcgtcagaagagttatgcagatcggagagttcgagatttatctttcatggttggtgagaaggtcttgctgaaggtatcgcctataaaaaggcgttatgaggtttgggaagaaagggaagttgagtcctcgatctataggtccttttgagattcttggtaaggttggagaggtggcctatcagcttgctttgctgcccagggtatcgggagttcatccgttgtttcatgtttctatgctccggaagtatgttgaggatccgtcccatattttagacttcggttcgattcagctagatgatgatttgacttacgatgtggagccggtagccattttgggtcgtcaggttcgcaagttgaggtctaaagatatagcttcggtaaaggttcagtagagaggtcgtcctgtggaggaggccacttgggagaccgagcaggagatgcagagcagataccctcacttgtttactgcttcaggtatgtctcttgacccgctcaaggacgagcgtttgttttagttggggaggatgtaatgacccgacccgtcattcttatatttcagcccgttatccccgtgtgttgttatgtgtattcggggagttgggaacggtttggatgggaatcggataggaatgggttaaagagtccctttaagaggaacttgagttggaaaggtcaacccgacgttgacctatgggttagagggctcggaacggatttccgatggctcgactagtttcaggggttgatttgtgacttagtagtgaaagcggaaatgaattcggagttccggagtgaaagttagctaggtttggcgaagttggaaattcggaagaatccggtcgataggtgagaaagtgatccgagggtcggaataggattccgaaagttgcattagctccgttaggtgattttggatgtgtctgcaaattttcaggtcatttggactttgtttggttggtttcggcatcggatatgaattttgaaagtttaagtctaagcttgaatttaattctatgattttgatgatttttggtgttaaaggtagcgttcttatgattcgaacaagtttgaatgaagtattaggttgagtttgtgcctttggttgaggtcccgggggcctcggggtgatttcagatggtttggcggattggttttggaccttgtggtgctgcagaaatgcagtcagctgttgcagaggagttatctctatgcgatcgcagggtccttatgcgatcgcatagaaggaattatggggggtggtcagttgagctttgcgaacgcacagcttgggtgcgaacgcattgaagaaacctggagggccatggggatgtgctatgcgaacgcactggccaagtgcaaacgcagagaggacctggggaaggttgaggagaagtactatgcgatcgcacagtgaggccgcgatcgcatagagataggacgcctgggcagattatgttttaagtcttgttttgtccgcgagccatgggttatttccaccatttttaagaaaccttgagagctcattgacggaatttgaaggggatttcatcgggagatcattggaggtaagtctcgtggtcataatacgcctttttattgaagaattaagtttaaaatctctgaaattgggtgaaattaatgaagacctagggcttgagttttggtactttaaatgatgatttggaggatcaattggactccgattttgataaattttatatgtatggactcgtggcaagacgagggtcattttggtgtaaagttttctggttttcgagatgtgggcccggggctcgggttttgcgatttttgcgaattgtgatgtttttcgagttctttcaattgggttatgacccattagccttgtgtaatatattcgttgtggttttggccagattcgacgctcgtagaggcggatttgaggcaaaagggcatttcgagctagtctacggccggctagaggtgagtaatgtcagcaaatgctgttctgagggtttggaaccccggactttcacatcgtaacgctatattgaggcgtgacacgcactccatgataagtgcggggtcggatattgttggggattgagacttggtccatcccgagtgactcttatactatatgggcgtatgatacgcatactgtgatgattgttatgaggctttaggccgtgtttggggcctagcgccgacctgttaaatccttcgggagttatcatttactgtttagcatgacatgcatttcgtatactatcagtccatgctttttaaaacactgttctacaaacccagccgcattttctaagtttcaaaactcatatgtcatcttttaaatacatatcggctgagggtaactattctttaggctacatgtccgccgtgggccccaatggggtagatccggtgtagcagggccggcgacgccgtgggccccaatggggtagattcgggtcgttataaatggtaacatggacacatgtgtgatatgatcggtcaggtaacatggactggcctagtattgatttcgccactagatggctggttattgcgcttgggctgtaggagcccctccggagtctgtacaaacccccagtgagcgccgtcgatgataaacgatatgggtggctcgggctgcacgccgcagtgggtactggattgtaccatcatttgcattgcatcgcatctctgcattgcatcatatatatattgtgtttagctgcttagttcagatattgtgatatcctgctttatagtctactttgtgttattcatgtattccttatctttagggctttatttcctgttattactcactgggtcggagtactcacattactccctgcaccttgtgtgcagatccagggcatactcaggcggattagcttccggggttctcaggcgacagcatcagagtgttgaggtagctgcacggcgttcgcagccatcaactctccctctatccttatcttcagttttcattgtactttcagtttttgaacagatgtatcagatttatttcattatactctagaggctcggacttgtgacaccggttccttggtggcttatctttggttgttctgatttttccgcagttttcagtaattaaatctcgtatcttattaagtcatttttgtttgagttcctttatttggggaaatgttggtattgtggtcaggcttgcctagcctcacggccgggcgccatggcgaccgggatttggggtcgtgacatatgtcaatcattttagattcaatatcatggtacatgaattactaccatttttgtgagattttttcaaaagatatgctcttcaaattaagatgaaatacgtgttctccaatacaaaatgtgtatcgatcattttacttttaaaaataaattttagaattgttataaaactaattatttttaaatatgacgacaaatagagttaatcaatatcagaattatttaaatgctaattccacttgaataataatatattgaaactaaatatactctttcaagtataattctgagtcattctccagagtaaatatatctttgatgagccatccttcaattgtattttactagcttactttaatattcctttcgaatgtcttagattttgtgttcatctgaaatttatggattatcagttgtttgttatatatctgaagttccatccactatttatgttttcatcgactgtgtactactgaaactgaaaaggaagcatgctaactttatttattaaaaagtggcataaattttaaggtgaattattaacggatgattgaggatttctatgagatatttttctcgtaattgagttagttacacgtacaatgtcaatattaatggttattgtcaggaacttatacttttatttcataactcaaacactcattgagacaggatacacgcgcgatgcgcacatcctgaatgatttttttattatttcttattggaaaaaaactataattacaattaaatatttaaaacttgggatgagctattattaagatttgaatcaacaaaaaaaaaatctctttaacgttaagaacaattctaattaaacaaaaatgtctttgctttaactaatttgcgaaaaatccaagtcatttttttcgaaatttataataaaatagattataatgtaatagtaagagttaaactgttaaaatacaaacattaaaaatagtaagaatgaaatattagaagacaaaatatattctaagttagttgccattaattaattttctttctggtattcgttcaaataaatgacaattccctatacttttctatgtacaaagttacttattttaaaatattaacttaatgtagacattttacttaacatttgatattttgatttacatgttcttcatatacacatattttattgattgacgctaaccacacgtgcaacgcacgtacactaaaactaatttatttcaaaaataggaaatcttaattttataacaaagatcggtcgtatataaccttttaaagcaaatcatattattttagaaactatatttgacatacgatagttccaggaaggagaggaggagaaaacaagaaaaagaatcctataaaaatgagacttctatatgtgtgtatatatttactactgtagttgtagggtaagtgacccgctttagcctcgtcactacttcgtcgaggttaggcttgacacttatcagtacatggggtcggttgtactgatactacactctgtacttttgtgcagattttggagtcggccccggtggcggctaccagagagctcggatcggacagttgcggagacttgaggtacggttactcagcgcccgcagcccctggagtccccttcccctttctatttagttgtgtaaatttattcaggcaactttgtgtttatttcagacccttgtatgtactattctagtagcccgtgcacttgtgacaccaggttcagtaattttgtagtaggtttttgagagctttagcttccacattaatattttagttatttcattatttctcgttattcaattcaactgttaatggataatgtgttctaatgttggcttgcctagcaagtaaaatattaggcgccatcatggtcccgacggtgggaattcccgatcgtgacaggaacggtcaagacgtctactggactaaataacctgagcaaatataagtgtagtactaacagaatatgatatctctataaaactatgcataatgacgataataatatggtacttgcaataagaattagaaacaacaactagcaacgtaacacaacaggtaataacacaataaagcaagccgaacacagtttaaattcggtgatcacaattaaaagaagaacatgtagcaactagatgagagtaaccactttcacatcaggttttatccaataattatcacgaggtaccaagcctcggaatatccacaagtcacgggtcccactttatgaaccctaaatacttggcattttgtaccctcatttaatttagtaccgcacggacgacgctcgtgccaatagaaccatttttacatagaaaacaagcagacaatggtgtgcatcaatactcaacaatatcaggatccatcctcttaaaccgataggagtgattaactacgtgtatgcttgtgcaagtgtcctaacatagctcatgccaactagtaagtatagagaaaagaacagcacgtaagaatgttttctcacaatgtttcacaagataaaactcacactagtaggtacaccactatgaaaatattaacaacaagaatgcccccgggccatcacaaggtatcacaaatcaatccctgacacaacccactttgtctcgccacgtgcgcaataataaagtaaatgcatgtcttgtctcgccacacgtgcataatgacattcccaccttgtcttgccacatgcgcaacccacatatatagcttgccttctcacaccgtatgtggacatatcaatagtaataatagcacgacagaaacctcctgcaacaaaactacaaccgcactgcagaaacctcttgcatcacaataacaaccgcacaactgaaacctcgggcattacaataacaaactgcacgccagaaacctcgtgcatcacaatactaagtacaacagcaataatgacaacaacacaagagtatgacaagtaaattaactcaagagctttcgatcacaaaaaaagatagaactagttcacaaaaaataaacacaatagagaatagctcaacaaaggagaaataatatgtaacaacaatcccataatgtacagttcaacaacaagggagataacacgagtaaaataatttcaaataaggacaggtaaactaagatataggatatttaaacttcttttaaggttgagcaattacgaaaaagatacaacaatttaattaggggtaagcagcgaaaatataatcataacctcaattaaggatggacaattacacgagagatatttatgccttcaattaaggagaagcgactagggagggatagcatggcaataaaagaggtaacaacttcagttaagtcatatacgagtcaagtaggcaataagagtggatcgtgaagcaattaattctaattaaagcatgtagagatgaaactagtaaatgggaaacttaatcatacaaaataacttcatattcaaggaacataaggacttaagagccctaaaagttcaactttacacaaataagcccgagcacgtactcgtcaccttgcgtacacgaactttacaagatacaattagcatagaagactcaaatcctaaggggtagttcccccacacgaagttaggcaagatacttacctcaaataagacagtataatactctaaaatgaatttctcgggcgaattaacctccggatagctcaagtttagccaaacaacttcaaagcataaataaaactcataagaaatcattacggataataaagcttcaatcttaatcaacaacaaacctagtatgttcccaccatatagggtttggggagggtagtctgtacgcagatcttacccctacttaacaggtagagaggttgtttctattagactttcgactcaggaagggtaatacgaaaaagagaatagaaagaaaggaagaaatatggaagagaaaagaaaagaaagagataaagaataagtagtaccaaataatagcaacagagaatacaatacccgaggcgagcaaaaccacataacataataaaaatctaagaagggacatgcgtgctactaagactatcggcgagcaactaaaaactacccactaaccttctacctaattaatccttgacctccacaccctcctaccaagagtcatgtcctcagtaagctgaatcagcgccatatcctgtctaatcacctctccctagtacttcttaggcctacctcgacctcttctcaaactcttcatggctaacctctcacacctcctaacaggagcatcaatgcttcttatcttaacatgtccgaaccatctcagcttcgactttcgcatcttgtcctccacggaggctactctcactctgtctcggataacttcattcttgatcttatctctcctggtacacctatacatccatcgcaacatcctcttctctgctactttcatcttctgcacgtaggagttcttgactggccaacactcagccccatacagcatagccggtcgaaccaccactctataaaacatacccttaagtcttggtggcacatttttgtcacataaaataccaaaatcgagcctccttttcatccaacctgctccaatgcgatgtgcgacatcttcgtcaatctccctgttatcttggataatagacccaagatacttaaaactcgctctcttggggataacttaagcataaagctttacctatatgtctgcttcatgggtcccgtcactgaattttcactccaagtattttattttgattctactcaatttgaaatctttagactccaaggtctatctctaaacctccaaccttgcattaactctgtttcgcatctcgtcaatcaacactatatcatcggcaaatagcatgcaccaaggaccctccccttgtatgtgttgcgacagtacatccatcactaaggcaaataaaaatgggctaagagccgaaccctggtgcaaccccatcaccacaggaaaatgctccgagtcaccacccacagtcatcacccgagtcttagcatcgtcatacatatccttaatcaccttattgtacaccaccggaacgccgctagccttcaaacacctccacaagaccacccttgggactttatcgtatgctttctcaaggtcaataaacaccatatacaagtccttcttcctctcgctgtagtgctccactaatctccttcttagatgaatcgcttttgtagtcgtatgccccagcatgactccaactgattctcggaaatagactcgcacctcctcaccctagcctccaccaccctctcccaaatcttcatagtgtgactcaacagcttgatacccctataattattataattttggatatcacccttgttcttgtaaagagaatccatcgtgctccacctccattcttcgggcatcttcttcatcttaaaaataacattaaacacaccagtgatccactccaaacctgctcgccctgctgtcacgaccctagttcaccaactgtgaacctgtcatgatggcacctggtcggagagaccaggtaagcctaacacattgcggaattcaacaatcattatgaaaagtaacaacaaaaattgaataacaagagaaatgtatacaatgccgcgtggcacatacattttacccaataaaatttagaacaactcccaagacccggaaactcacaaaccacaagcaaggggaaatacataaggctctaactcaagaatgtctatagaaacgaaatactggaaatgactatactattgcagaagctgcaaagggactcctcgatctgcggacgcagcagacatacctcgaagtctctaccgaataagcctccttccaaggctgacagaactgaatgggagtacctgtatctgcacaacaaaagtgtgcagaagagtagtatgagcacaccacagcggtgcccagtaagtatcaagactaacctcgatggggtagtgacgaggaacagtcaagacacctacaggtcaataaacagtataatcatgtgaataataaagacgatatatgtgattatgtacatactgcataaatgactaaaagtgctacaattcacaataaggagaaaaaaacaacaagtagcaacgagaacacaataaatgataatacgaatgaaggcagaatcacaatccaaagcctaaggtcacaacatagcaagaacagtaagttaccaattcttattctacgatgatgcttacatagggtcttattcaactcttcccacaatcattacaacaccttggacaaaccacaattcacgaggaaaacccaacatctgaagtctaacacctagcatcctatgccccataaatctcacgatcctgctgacaactcactggctatctaggaccactctcatatatataatgggtaaacgagggcacatctccacccttagccaaattggaaggaattcacctctaatagggtgtccctctacgtgtatgcttgtgcaagtgtgattaattaggatcctacagactagtaggtataagaaatagcacgaccatcacccgaagtgtttgcataactacaacaattcaatacagaatatacatgtcagcaacaattgaacgaaatactgaaatagcacgaaaaggtgcagctcaatgccaataatgccataaggatctcccaggataccgtcctgtagtcctttctcaactgtccagtggatctcccgggataccgtcccatagtccatcttgtatataaatatccgaaggatctcccgggatatcgtcccgtagtccaacatatcaatatccaatactggggaaatctaccggctgcattgccgtagttccataccattgttcagggggagctaccggaatcccacattcgtagtcccaaaataaataataggtggaactcccggaatcccacattcgtagtcccaaagtaaacaaacaagggggaactcccggaatcccacatccgtaaccccaatgtaaatgcacaccaagagcaagagaagaacaacatcccgtcaagggagtcaacaacagatacaacaagtcccgacaagggaatcaacaataagaacaacaacgtcccggcaagggaatcatcaataagaacaacaacgtcccggcaagggaatcatcaataagaacaacaatgtcacggcaagggaatcaacaatacaaaaggaggatcacggaaaataataagaatgataacctcaacaagaatatcaagacataaaaagcgtgatagctacaccggtaatcacaacagttgtcatatacttgcacgcagtcacagatgggtttacagtcgaggagtatccaataataaggaagttaacatgagataaataattacaattagagagttatcaactaaacataggatatctacttcttttcaattaatgtcaaatagatttcatgagaagtaagggtaatgatttccaattagagacaagcagtttggagagataacgtagctataataggaataacgtttccaattaaacaagtaggagtcaactaagcagcaggaataaccaaaagagcaaataaattccaagtaacatgttgaagtgaaactaataatggggaaacttaatcatatcaagaacaacttcatactcggtgaattcaaaggtctaagagcctaaaagggtcaatttaccacaaataaatccgagcacacactcgtcacctcgcgtgcaaggaatacaatcaacacagaagactcaaatcctaaggggaagtcccccacacaaggttaggcaagatacttacctcaaaaccggctaaaatcaactagcaaccacgttcttgccacgagttctcgactccaaatggcccaaatctattcaattaaatcacatattgtaaataatatctcaagcaactgattctacaatttaattcaaagctaaaatgcgaaattaggtaaaatgaccaaaacgcccctcgggcaaacgtctcggaactagatgaatttaacattttcagaaccctcgcactctcacgagtctaaccatataaacatatctcaaatcggaggttaaagactccctcaaaattcaacaattcggtctatgaagttctacccattttacattcaaaaactgaaattaaatgatgaaattaagaggagattcatggatgttggtctagattgattgagaataacttacccaagtttcccaggtaaaaatcccttcaaaaatcaccaagaaccgagctccataagtcaaaaatgagaaataatggtgaaaccctcgaaattgggatttaaaactgtctggcagttatttgttctatcgatcgcagagcatggattgcgatcgcatagaggaacttgagagggcccagaaattgtgctctgcgttcgcgtaaaaagggatgcgatcgcagagggttgggatgggggcttatgcgatcgcggagtgaaccatgcgaacgcattgaaggaaaatatgggggtccagtggttggcctatgcgaacgcgggcagaggatgcgatcgcgaagagaagagaggaaggccctctgcgatcgcaggcacacgagtgcgatcgcactgaaggcgtactagaagcagcaacagcagtttcaagcaagggaaaaatgacccgtagcccatccggaacacacccgaggcccccggacaccccgtctaatcacacacgcgagtcatataacctaacacggactcgctcgaagtttcaaatcacataaaacaacatcgaaacgacgaatcaagcctaaaatcgagctaatgaactttcaaatcttcaaatatcaaatcctttgccgaaacctatcaattcgactcggaatgacgccaaactttacggacaagtccaaaatgacataacggagcttctctaaatctcggaatcatattccgaccccgatatcccaaaagtcaactgtgagtcaaacttcttcattttccaacttcaatttcgccgaaatgcctcaatttactctacagacctccaaatctgaatccggacacgcgcctaagtccaaaatcaccatacaaagctggtgagatcatccacgacccattccggggtcgtttatacaaaagtccaattccggtcaacttttcaccgttctaacttccaaacaaggtttcttctttagaattgactccaaaccatccgaaaaccgaattctaccatgcacgcaagtcgatactcatattccgaagttgttccgaaccttatgccgctgaacggaacttaattcctcaaaacgaccggtcgagtcgttacatcctccccctcttaaaaccaacattcgtcctcgaacgtgctaagattcgcctcgaagtcctcaagtcactgagtgcgtacttccaatatatactcgcgggtgatcccacgtcaccccactccacataagcacgttctacctaggcagtgacgacactaccttaactgaaatttatcccttctagcaataccaataagccttcaagccaaaaattttcaccttccatccagtttcaaaagacccgattctaacttcatatccggtatcagccccacccagctatttcaataccagccaacacacacagggtacagccacacaatatgacacaccacacatagacccacaataatatttctgatagcaatacctgcctgagatcgaatctgcactggccttaagcctcatattcaatagaaactctttccccaacctccacaacactggtgatgatgcaatagccatgaaaaccacataacaaaatacccgaataaccaaatctcagccaacaccatcaggtgcacacctcacaaactaaaactcaagaagcatagaatgaaaatgaataaatacgggaaaggaaaacacgtaaaggaactaacaaacaaatcaaactagcataaattcttctaaaacacaaatctacaaagacaactaacaagaaggaatgaaagcatatgaaaactcacgagggtcttatactgatataactctcaccgcagcataccgcccggtctcaacatatcaaaacacctgaaatcacgagggtttgattggatcacaagtagggctcatactaacccatctagaaactctcactagatcaattccgtccataatttacaacacacactggctcccacaccggtggagcatagaaatcacagctcgtaagcaagaatactcaaaggtggatcatggaaaataataagcacgataacctcaacaagaatatcaagacataaaaagcgtgatagctacaccgataatcacaacagttgtcatatacttgcacgtagtcacagatgggtttacagtcgaggagtatccaataataaggaagttaacatgaggcaaataattacaattagagagttatcaactaaacataggatatctacttcttttcaattaaggtcaaatagatttcataagaagggtaatgatttccaattagagacaagcagtttggagagataacgtagctatactaggaatatcgtttccagttaaacaagtaggagtcaactaagcagcaggaataaccaaaagagcaaataaattccaagtaagacatgttgaagtgaaactaataacggggaaacttaatcatatcaagaacaacttcatactctgtgaattcaaaggtctaagaccataaataaatccgagcacacactcgtcacctgattgtcccaaacctcggaccgaggtgtcacaatgaggtattcaggcagatagagggcgcccaagagggggaggcccgactgttgatgtatttcatatagtagtcttgaggccggtgtgccagctaatgtcattcaggtactaattcagttgttatggagaggcactatctgtggttcatcacaattctactcatcaggttgagttccttgtatgttgttccatttatgggagtgcttcatgatttgcactctatttatgtgattatcctgtttgggaggttctataagtgatagccgtgtctatcatctatttctgagtgttgttgagagttgtgaggctagtagtaaattcctgttgtttgttggtaggtttgatgccacctttgagtattcttgcttacgagctgtgatttctatgctccaccggtgtgggagcaagtgtgttgtaaattatggatggaattgatctagtgagagtttctagatgggttagtatgagccctacttgtgattcaatcaaaccctcgtgatttcaggtgttttgatatgttgagaccgggcggtatgctgcggtgagagttatatcagtataagaccctcgtgagttttcatatgctttcattcctgcttgttagttgtctttgtagatttgtgttttagaagaatttatgctagtttgatttgtttgttagttcctttatgtgttttcctttcccgtatttattcattttcattccatgcttcttgagttttagtttgtgaggtgtgcacctgatggtgttggctgagatttggttattcgggtattttgttatgcggttttcatggttattgcatcatcaccagtgttgtggaggttgggaaaagagtttctattgaatatgaggcttaaggccagtgcagattcgatctcaggcaagtattgctatcagaaatattattgtgggtctatgtgtggtgtgtcatgttgtgtggctgtaccctgtgtgtcttggctggtattgaaatagctgggtggggctgataccggatatgaagttagaatcgggtcttttgaaactggatggaaggtgaaaatttttggcttgaaggcttattggtattgctagaagggctaaatttcagttaaggtagtgtcgtcactgcctaggtagaacgtgcttatgtggagtgggggtgatgtgggatcacctgcgggtatatattggaagtacgcactcagtgacttgaggacttcgaggcgaatcttagcacgttcggggacgaacgttggttttaagaaggggaggatgtaatgacccgaccggtcattttgaggaattaagttccgttcagtggcataaggtccggaacatcttcgaaatatgagtatcgacttgcgtgcatggtggaattcggttttcggatggtttggagtcaattctaaagaagaaacctgttttggaagttagaacaatgaaaagttgaccggaattggactttggtgtaaacgaccccggaatgggtcgttgatgatctcaacagcttcgtatggtgattttggacttaggcgcgcgtccggatgcagatttggaggtccgtagagtaaattgaggcatttcggcgaaaattgaagttggaaaatgaagaagtttgactcacagttgacttttaggatatcggggtcgcaatgtgattccgagagttagagcagctccgttatgtcattttggacttatccgtaaagtttgacgtcattctgagttgaattgataggtttcggcaaaggatttgatatttgaagatttgaaagttcattagctcgattttaggcttgatttgtcgtttcgatgttgttttatgtgatttgaaacttcgaacgagtccgtgttaggttatatgacttgcgtgtgtgattagacggggtttccggtggcctcgggtgtgttccggatgggctacgtgtcatttttcccttgcttgaaactgctgttgctgcttctggtacgccttcagtgcgatctcactcgtgtgcctacgatcgcagagggccttcctctcttctcttcgcgatcgcatcctctgcccgcgttcgcaaaggccaaccactggacccccatattttccttcaatgcgttcgcatggttcactccgcgatcgcatgagccctcatcccaaccctctgcgatcgcatccctttttacgcgaacgcagagcacaatttctgggccctctcaagttcctctatgcgatcgcaatccatgctccgcgatcgcatagaacaaataactggcagacggttttaaatcccaatttcgagggtttcattattatttctcatttttgacttatggagctcggttcttggcgatttttgaagggattttcacctgggcaacttgggtaagtgattctcactcaatctagaccaacttccatgaatctcctcttaatttcatcatttaatttcagtttttgaatgtgaaatgggtagaacttcatagaccgaattgttgagttttgagggagtgtttgacctccgatatgagatatctttatatggttagactcgtgagagtgcgagggttctgaaaatgttaaatttatctggttccgagatgttggcccgaggggtgttttggtcattttacctaatttcgcgttttagctttgaattaaattgtataatcagttgcttgagatattatttacaatatgtgatttaattgaatagatttgggccatttggagtcgagaaatcgtggcaagtacgtggttgctagttgattttagccgattttgaggtaagtatcttgcctaaccttgtgtgggggacttccgcttaggatttgagtcttctgtgttgattgtatttcttgcacgcgaggtgacgagtgtgtgctcagatttatttgtggtaaattgacccttttaggctcttagacctttgaattcaccgagtatgaagttgttcttgatatgattaagtttccccgttattagtttcacttcaacatgtcttacttggaatttatttgctcttttggttattcctgctgcttattgactcctacttgtttaactggaaatgttattagctactttatctctccaaactgcttgtctctaattggaaatcattacccttacttctcatgaaatctatttgaccttaattgaaaagaagtagatatcctatgtttagttgatagctctctaattgtaattatttgtctcatgttaacttccttattattggatactcctcgactgtaaacccatctgtgaccacgtgcaagtatatgacaactgttgtgattaccggtgtagctatcacgctttttatgtcttgatattcttgttgaggttatcgtgtttattgttttccgtgatcctccttttgtattgttgattcccttgccgggacgttgttgttcttattgatgattcccttgccgggacgttgttgttcttattgatgattcccttgccgggacgttgttgttcttattgttgattcccttgccgggacttgttgtatctgttgttgactcccttgccgggatgttgttgttctcttgctgttggtgtgcatttacattgggactatggatgtgagattctgggaattccacctgttatttattttgggactacggatgtgggattccggtagctccccctgcacaatggtatggaactacgacaatgcagccagtagattcccccagtactgggtattgatatgttggactacgagacggtatcccgggagatcattcggatatttatatacatgatggactacgggacggtatcccgggagatccactggacagttgagaaaggactacaggacggtatcctgggagatccttatggcatcattggtatggagctgcaccttttcgtgctatttctgtatttcgttcagttgttgctgacatgttgtcgcgacccggattttcccaccaacgggtatcgtgatggcgcctactgtcggagctaggcaagccaaactaacatgcatctaactattactaatcaacaataatcataagtaaagcagtaaaataaagcggaagtcttaattaatttaaccactgcaaaagtgcggaagaatttaatacaatcctctacccaagaactagtgtcacagcactcacagactactaggagtcactacatacaaccgtttgaataaagaaatacaagatcgtctgtctgaatagataaataaactgaatctaagaagaagagactggatggcccacagacgccagtgaactacctcgcagtctctggactgaaggctggctccctgactactgctgatgcgctccaaaagctgctcccggatctgtgcacaatagggcacagaagtgtagtatcaacacaatccgaccccatgtgctggtaagtgcatggcctaaccccggctcacgaggtagtgacgaggctagacaggacctacagcgttaacctgtgcaagatatatatacatacgaaaacaggaataatactacaaagtaaacaagtacgggaggggacatgctataaggggaaaaacagttcaacagacaaactaatcagaagtacgtaatacggaactaaaattaagcagagaagtctgagatgtcgactacaatgcaaaacaactgcctttactttcaaacattacaacagtaatcaaacattgcacggcaacgaccatcgtgcttctcgtcctcccacactctcataccatggcacggtaagacccgtcgtgcttaatcatttcaataacatggcacggaaagacccctcgtgcatcaacagttcaataatatggcacggaaggacccgtcgtgcatgaacactctccctcgctaaataatgagaactcaatcaacacataacggggaaaggatataaatgccatcaaagatcccgacaagggtagcaataacaaactttcatctcaaaatcaagtaagtgccaacaatccctaataagagccaataccccacaataagtcactacttattctccaccgaacacttcatatgaactcaatcaatttaagcaacaagtcttttcataatattcgaatttaaacaaggtaagacccacggtcatgcttgactcgggtgcataggtaaccgtcaccaaacctatacaccgacccacacaacacgtagcaaataatattctaatcctagtccctcgaaccaaagttaggacaaacacttacctcgatgccgaactagcaattcaaagctctacaaccgcctttcctttagaatccaactcccaaacaatgatatctaatcataaattacccaagtgaattaataaattctaattaaactaatttgaatgcataaggatgagtttcccaaagttttacccaaaaattcccaaaatgcccccgggcccacgtggtcgaaactcgaggttcggaccaaaaccgggttacccattccctcatgagctcatatctataattggaattgaaattggacctcaaatcgaggtctaaaagcttaaaatatgaaaaaaccctagtttctacacaaacctccatttttaacccatgaaaagctttgatttaagatgaaatcatgttagatgatgatgatgattgaagaaaacaagtaaaaatggacttacaatcgaattggagaagaaagagttgagagaaaatcggacaagagggttttgggttttgaaataatgaaaatgagcttcaaaaatcgtttaagtaatttttacacaggtgcagacttcacaaatgcgaagttaaattcgcaaatgcgaattggatgaagaaatgaggaaaagtcgcatttgcaataaagatttcgcatttgcgaaatggacaggggaaagagggaagtcgcaattgcgacttatatttcgcatttgcgaaattggggctggggaagggaaagtcgcatttgcgacatatacttcgcaattgcgaaggctggaagagtaagggggacttcgcaaatgcgaagtctatctcgcatttgcgagatcgggctggaaagggaccatttcgcaattgcgaacaaggcttcgcaattgcgaacaaggcttcgcaattgcgaacaatgcttcgcaattgcgaagcctgtaggtctgaggcatctgctgcaattccaaccatgcaaaaatgcatccgacccctatccaaaacactcccaagccctcggggctccaaaccaaacatgcacactacctcaaaaacaccctacagacttactcgtgcgatcaaatcgccaaaataacatcataatctatgggttaagccccaaaatcgcaattccactctttaacacatgaaactcaagatttctatattcaagccgaaacacgtcaaacgacgtccgattcatatgaaactctacagatagcgcttaaacaacacataggacctataccgggcgtcggaaccaaaatactagcccgatacgatagttttcaaatcaattttcattttccttttccttaattaatttcagaaacaatttttacgaaaaaattcataactcgggcctgggacctcggaattcgattccgggcatacgcccacgtcccatattttactacggattttccgaaattgacggaccacgggtccgggcccgtttgctcaaaatgttgaccgaagtcaaccctatcaatattatacttaaaatttcacaatttcaacacacaattcaactttcgcattgtaaaaactttccggcttcgcgcccgaactacgcacgccaatcgaggcaacccctcaagaggttttcgaggcctcagaagcacggagcaaagaagaattacggtgatgaccccattgggtcgtcacaatctccacctctaaaacaaccgttcgtcctcgaacggacaaaagaaagaagtacctgagtcgggaaatagatggggataacggctacgcatatcggactcggactcccatgtcgaagcctcgggaggctgacctctccactgaacacgcactgaaggaaaactcttcgacctcaactgtcgaacctgccggtctagaatagccatcggctcctcctcataagacagatccttgtccaattggacagtgctgaaatccaaaacatgcgatggatcgccgtgatacttccggagcatggatacatggaacactggatgcacagctgataaactaggtggcaaagcaagtctataggccacctcccccactcgctccagaatctcgaacggaccgatgaacctagggctaagcttgcccttcttcccaaacctcatcacgcccttcataggcgacacacggagaaatactcgctcaccaaccatgaaagcaacatctctgaccttgcggtctgcataactcttctgcctggacagagctgtacggagtctatcctgaatggtcttgaccttatccaaggcctcctgaaccatatctgtacccaataaccgagcctctcccggctcaaaccatccgattggggacctacacctcctaccatacaacgcctcatatggagccgtctgaatgctggactggtagctattgttgtaggcaaactctgctaatggcaaaaactggtcccacgagcctccaaaatcaatgacgcaggctcgaagcatatcctcaagaatctgaaccgtcctctcggactgaccgtccgtctgtggatgaaatgatgtgctcatctgaacccgagtgcccaactctccctgcaaggctgtccagaaacgcgaagtaaactgcggacctcgatccgaaatgatagatatgggcaccccatgaagacgaactatctctctgatgtaaatctcagctaatccctgggacgaataggtggtagcaaccggaatgaagtgcgctgacttagtcagcctatccacaataacccaaactgaatcacactgcctccgagtcatcgtgaggccagtaacaaaatccatggtaatcctctcccacttccactcgggaagctcaatcctttgaaatagaccaccgggtctctgatgctcatacttaacctgctgacaattaaaacaccgagcgacataagcgactatatccttcttcatcctacgccacaaataatgctgtctcaaatcctgatacatctttgcggcgcccgggtgaatagaataccgagaactgtgggcctccgctaagatcaaatcacgaataccatcgacattgggcacacaaactcgcccctgcaatcttaacacaccatcatctcccaaagtcactttcttggcacctcctcgctgaactgtgtctctcaggacacataaatggggatcatgaaactgaagctcgcgaatacgctcaaatagagaagatcgggcaaccgtacaagccaaaaccctgccgggctccgaaacatccaacctaacaaaacgattggccaaggcctgaacatccaaggcaagcgatctctgaccaactgggatgaaagcaagactacccatgctagccgacttcctactcaatgcatcggccaccacattggccttccccggatgatcactctaaccatctgctcggcctcatattcaactccttctgcttgaacagatactgaagactcttatgatcggtgtaaacctcacacgtcacaccatataagtaatgcctccaaatctttaaggcatgaacaatcgctgctaattcaaggtcatgaactggataattcttctcgtggatcttcaactgcctcgaagcgtaggctataaccttaccattctgcatcaacactgcaccaagccaaatacgggaagcatcacaatagaccgtgtacagtcctgaacctgtaggcaacactaataccggtgctgtggtcaatgctgtcttgagcttctgaaagctcgcctcacactcgtccgaccacctggataaggcacccttctgggtcaatctggtcataggggatggaatggatgaaaacccctctacgaaccgtctataatgaccagctaaccctaagaagctccgaatctctgtagctgaagctggtcgaggccaattcttgactacctctatcttcttcgggtctacctgaataccatctgctgaaaccacatgacccaagaatgctactgaactcaaccaaaactcgcattttgagaacttagcatacaactgactatccttcagagtctgaagaaccactctgaggtgctgctcatgctcctcccgactgcgggagtatataagaatatcatcaataaagacaatcacaaataaatccagatacgcctgaataccctattcctcaactccatgaatgttgctggggcattagtcaatccaaacgacatgaccagaaactcgtagtgcccatatcgagtacgaaatgctgtcttagggacatcagacgccctaatcctcagttgatgataaccagatctcaaatctatcttggaaaataccttcgaaccctgaagctgatcaaataaatcgtcgatcctcggcagtggatacttgttcttgatcgttaccttgttcaactgccggtaatcaatgcacattctcatagaaccatccttcttctttacaaataggactggagcaccccaaggcgacacactgggtctaatgaaacccttctcaagcaagtcctgaagctggtcttttaactctttcaactctggcggcgccatgcgataaggcgggatagaaatgggctgagtgcccggcgccaaatcaatacagaaatcgatgtccctgtcgggcggcatgcccggcaaatcagaaggaaaaacctcagggaactctcgaacaataggaacagaatcaatagacgggacctcagcgctggagtcgcgaacataagccagataagctaagcaccccttctcgaccatgcgtcgagccttcacatatgaaataacgctgcgagtggtatgaccgggggtccctttccactctaatcggggcatatccggcaacgccaaggtcacggtcttggcatgacaatccaagatcgcatgattaggagacaaccaatccatccctagaatgacgtcgaaatccaccatatccaacaataacaagtcgacacgggtctcaagacccctgaataccacaacacacgaatgatgaacccgatccactactatagaatcccccactggagtagatacatgaacaggaatacccaaagcctcactaggcataaccaaataaggtgcaaaatatgacgacacataggaatacgtggatccaggatcaaataatactgaagcatctctatcacaaaccagaatagtacctgtaatcactacatcagacgactcagcctctggtctggctggcaaggcataacaacggggctgggccccacctccctgaatggcatctctaggctgatctactgctgcctgacccctacctctagctggctgagctccacctctatgacctctgcctccacctctatgacctcaacccccgcctctagctggctgggtagactgtggggcaggtggtgcctgaatcatgggacggggtccctgcggctgggatctactcgaagcatagggacaaaatctgataatgtggcctggatcgccacaaccatggcaaaccctcggccgctggggctgctgaacctgtcggcttgaatgtcctccccggaagctctggagtggcggggcactaataggctgctgaccagaataatactgttgagaactgttgctacctggagtaccatgagaggcctggagagctgactgataaggcctcgggggctggcccctagcatgtgaacccctacctctagacgaggtaccactgaaccgaccagaatgacggggcctcttatctgacccggtaccacctcctaaagacagtgccatctcaatccggcgggcaccatccgccgcctcctgaaatgtgagatcactaccggcactcatagccatctgcactcggatatccagggtcaatccatccacaaatctcctaaccctctcgccctctgtgggaagtatcaataaagcatgacgggcaaggtccacaaatcgcgtctcatactgagtgacagtcatatatatctgctggagacactcaaactgacgacgaagagcatccctctgagtgacggggagaaacttccccaaaaacaactccgcaaattgatcccaagtaagagctggcgaccctgctggtctagtcagacagaaatccctccaccatgtcttggcggatccagccaggcggaatgtagctaagtcgaccccattggtctccagaacacccatggtcctcaagacctcatgacaactgtatagatagttctgagcatcctcagaaggtgcaccaccgaaagtatgagggaaaagcctggaaaacggtcaagtctccacaaggaatctgcggacatcgccgcaccatcactaggctggcccgaaataactgacggggctgctactacaggctgaactggcacaactgacggaactggcacagctggctgaatcggcgcaactagaggaactggcaccgcaggctgaactggggcaacctgctgtactggcggtgcctctggagtctgaaatcccagcgccactggctcaggtgtgcgcacaacgggggtctgagtgcctctccctgtctgtgaagtggctgctgcggcggtggctgagactacctgtgctaggccagagcaagccgacataatctgagctagggcctcctgaagacccgggataaccataggtatagctggggctggagtcttctcaacatgaacctggggctccaccgctggtgctgctgctcggggctgagctctgcccctaccacgtactctagcgcggcctcgccctctgcccctagctggagctgctgctggggcctcgggttgctgatcagatgaagaggaagctcgagttctcgccatctgcgaaggaacagagtagaaagataatcaatattgagaaacagagtcacacgacaagaatgaataaagtgagattttcctaactctgtagcttctggggaacatgtacagacgtctccgtaccgctccctcaaactctaccgagtttgtctgtgagctgtgagactcaagtaacctagtgctctaataccaacttgtcacgacccggatttttccaccaacgggtgtcgtgatggcgcctactgtcggagctaggcaagccaaactaacatgcatctaacaattactaatcaacaataatcataagtaaagcagtaaaataaagtggaagtcttaattaatttaacaactgcaaaagcgcggaagaatttaatataatcctctacccaagaaccagtgtcacagcactcacggactactaggagtcacaacatacaaccgtttgaataaagaaatacaagatcgcctgtctgaatagataaacaaactgaatctaagaagaagagactggatggcccacggacgccagtgaactatctcgcagtctctggactgaaggctggctccctgactactgctgatgcgctccaaaagctgctcccggatctgtgcacaaaagggcacagaagtatagtttcagcacaatccgaccccatgtgctggtaagtgcctggcctaaccccggctcacgaggtagtgacgaggctagacaggacctacagcgttaacctgtgcaagatatatataaatacgaaaacaggaataatactacaaagtaaacaagtacgggaggggacatgctataaggggaaaaactgttcaacagacaaactaatcagaagtacataatacagaactacaaattaagcagagaagtcagagatgtcgactacaatgcaaaacaactgcctttactttcaaacattacaacagtaatcaaacattgcacgacaacgaccatcgtgcttctcgtcctcccacactctcatatcatggcacggtaagacccgtcgtgcttaatcatttcaataacatggcacggaaagacccgtcatgcatcaacagttcaataatatggcacggaaggacccgtcgtgcatgaacactctccctcgctaaatcatgagaactcaatcaacacataacggggaaaggatataaataccatcaaagatcccgacaagggtagaaataacaaactttcatctcaaaatcaagtaagtgccaacaatccctaataagagccaataccccacaattaatacaagtcactacttattctccaccgaacacttcatatgaactcaatcaatttaagcaacaagtcttttcataatattcgaatttaaacaaggtaagacccacggtcatgcttgactcgggtgcataggtaaccgtcaccaaacctatacaccgacccacacaacacgtagcaaataatattctaatcctagtccctcgaaccaaagttaggacaaacacttacctcgatgccgaactagcaattcaaagctctagaaccgcctttcctttagaatccaactcccaaacaatgatatctaatcataaattacccaagtgaattaataaatgctaattaaactaatttgaatgcataaggatgagtttcccaaagttttacccagaaattcccaaaatgcccccgggcccacgtggtcgaaactcgaggttcggaccaaaaccgggttacccattccctcatgagctcatatctataattggaattgaaatcagacctcaaatcgaggtccaaaagctcaaaatatgaaaaaaccctagtttctacacaaacctccatttttaaccatgaaaagctttgatttaagatgaaatcatgttatatgatgatgatgattgaagaaaacaagtaaaaatggacttacaatcgaattggagaagaaagagtttagggaaaatcggacaagagggttttgggttttgaaataatgaaaatgagcttcaaaaatcgtttaagtaatttttacacaggtgcagacttcgcaaatgcgaagttaaattcgcaaatgcgaattggatgaagaaataaggaaaagttgcatttgcgataaagatttcgcatttgcaaaatggtcatgggaaagagggaagtcgcaattgcgacttatatttcgcatttgcgaaattggggctggggaagggaaagtcgcatttgcgacatatacttcgcaattgcaaaggctggaagagtaagggggacttcgcaaatgcgaagtctatctcgcatttgcgagatcgggctggaaagggaccatttcgcaattgcgaacaaggcttcgcaattgcgaagcctgtaggtctgaggcatctgctgcaattccaaccatgcaaaaatgcatccgacacctatccaaaacactcccgagccctcggggctccaaaccaaacatgcacactacctcaaaaacaccctacggacttactcgtgcgatcaaatcgccaaaataacatcataatctatgggttaagccccaaaatcacaattccactctttaacacatgaaactcaagatttctatattcaagccgaaacacgtcaaacgacgtccgattcatatgaaactctacagatagcgcttaaacaacacataagacctgtaccaggcgtcgaaaccaaaatacgagcccgatacgatagttttcaaatcaattttcattttccttttccttaattaatttcagaaacaattttcacggaaaaattcatactcgggcctgggacctcggaattcgattccgggcatacgcccacgtcccatattttactacggattttccaaaattgacggaccacaggtccgggcatgtttgctcaaaatgttgaccgaagtcaaccctatcaatattatacttaaaatttcacaatttcaacacacaattcaactttcgcattgtaaaaactttctggcttcgcacccgaactgcgcacacaaatcgaggtaacctctcaagaggttttcaaggcctcagaagcacggagcaaaggagaattacggtgatgaccccattgggtcgtcacaatctccacctctaaaacaaccgttcgtcctcgaacggacaaatgaaagaagtacctgagtcgggaaacagatggggataacggctacgcatatcggactcggtctcccaggtcgaagcctcaggaggctgacctctccactgaacacgcactgaaggaaaactcttcgacctcaactgtcgaacctgccggtctagaatagccactggcccctcctcataagatagatccttgtccaattgaacagtgctgaaatccaaaacatgcgatggatcgccgtgatacttccggagcatggatacatggaacactggatgcacagctgataaactaggtggcaaagcaagtctataggccacctcccccactcgctccagaatctcgaacggaccgatgaacctagggctaagcttgccgttcttcccaaacctcatcacgcccttcataggcgacacacggagcaatactcgctcaccaaccatgaaagcaaaatctctgaccttgcggtctgcataacttttctgcctggactgagttgtacggagtctatcctgaatgatcttgaccttatccaaggcctcctgaaccatatctgtacccaataaccgagcctctcccggctcaaaccatccgactggggacctacacctcctaccatacaacgcttcatatggagccatctgaatgctggactggtagctgttgttgtgggcaaactctgctaatggcaaaaactggtcccacgagcctccaaaatcaatgacgcaggctcgaagcatatcctcaagaatctgaaccgccctctcggactgaccgtccgtctgtggatgaaatgatgtgctcatctgaacccgagtgcccaactctccctgcaaggctgtccagaaacgcgaagtaaactgcggacctcgatccaaaataatagatatgggcaccccatgaagacgaactatctctctgatgtaaatctcagctaatctctgggacgaataggtggtagcaaccggaatgaagtgcgctgacttagtcagcctatccacaataaccaaaactgaatcacactgcctccgagtcatcgggaggctagtaacaaaatccatggtaatcctctcccacttccactcgggaagctcaatcctctgaaatagaccactgggtctctgatgctcatacttaacctgctgacaattcaaacaccgagcgacataagagactatatccttcttcatcctacgcaaccaataatgctgtctcaaatcctgatacatcttcgcggcgcccgggtgaatagaataccgagaactgtgggcctccgctaagatcaaatcacgaataccatcgacattgggcacacaaactcgcccctgtaatctcaacacaccatcatctcccaaagtcactttcttggcacctcctcgctgaaccgtgtctctcaggacacataaatggggataatgaaactgaagctcgcgaatacgctcaaatagagaagagcgggcaaccgtacaagccaaaaccctgccgggctccgaaacatccaacctaacaaaacgattggccaaggcatgaacatccaaggcaagcgatctcggaccaactgggatgaaagcaagactacccatgctagccgacttcctactcaatgcatcggccaccacattggccttccccggatgatatagaatagtaacatcataatctttcagcaactctaaccatctcctctgcctcatattcaactccttctgcttgaacagatactgaagactcttgtgatcggtgtaaatctcacacgtcacaccatataagtaatgcctccaaatctttaaggcatgaacaatcgctgctaattcatggtcatgaactggataattcttctcgtggatcttcaactgcctcgaagcgtaggctataaccttaccattctgcatcaatactgcaccaagcccaatacgggaagcatcacaatagaccttgtacggtcctgaacctgtaggcaacactaataccggtgccgtggtcaatgctgtcttgagcttctaaaagctcgcctcacattcgtccgaccacctgaataaggcacccttctgggtcaatctggtcataggggatgcaatggatgaaaacccctctacgaaccgtctataataaccagctaaccccaagaagctccgaatctctgtagttgaagctggtcgaggccaattcttgactgcctctatcttcttcgggtctacctaaataccctctgctgaaaccacatgacccaagaatgctactaaactcaaccaaaacttgcattttgagaacttagcatacagctgactatccttcagagtctgaagaaccactctgaggtgctgctcatgctcctcccgactgcaggagtatataagaatatcatcaataaagacaatcacaaacaaatccagatacggcctgaataccctattcatcaactccatgaatgttgctggggcattagtcaatccaaacgacatgaccagaaactcgtagtgcccataccgagtacgaaatgctgtcttagggacatcagacgccctaatcctcagttgatgataaccagatctcaaatctatcttggaaaataccttcgaaccctgaagctgatcaaataaatcgtcgatcctcggcagtggatacttgttcttgatcgttaccttgttcaactgccggtaatcaatgcacattctcatagaaccatccttcttctttacaaataggactggagcaccccagggcgacacactgggtctaatgaaacccttctcaagcaagtcctgaagctggtcttttaactctttcaactctggcggcgccatgcgataaggcgggatagaaatgggctgagtgcccggcgccaaatcaatacagaaatcgatgtccctgtcgggcggcatgcccggcaaatcagaaggaaaaacctcagggaactctcgaacaataggaacggaatcaatagacgggacctcagcgctggagtcgcgaacataagccagataagctaagcaccccttctcgaccatgcgtcgagccttcacatatgaaataacgctgcgagtggtatgaccgggggtccctctccactctaatcggggcatatccggcaactccaaggtcacagtcttggcatgacaatccaagatcgcatgataaggagacaaccaatccatccctagaatgatgtcgaaatccaccatatccaacaataacaagtcgacacgggtctcaagacccctgaataccacaacacacgaacgatgaacccgatccactactatagaatcccccactggagtagatacatgaacaggaatacccaaagcctcactaggcataaccaaataaggtgcaaaatatgacgacacataggaatacgtggatccaggatcaaataatactgaaccatctctatcacaaaccagaatagtacctgtaatcactgcattagacgactcaccctctggtctggctggcaaggcataacaacggggctgggccccacctccctgaatggcatctctaggctgatctactgctgcctgacccctacctctagctggctgagctccacctctatgacctctgcctccacctctatgacctctacccctgcctctagctggctgggcagactgtggggcaggtggtgcctgaatcatgggacggggtccctgcggctgggatctactcgaagcataggaacaaaatctgataatgtggcctggatcgcaacaaccatggcaaaccctcggctgctggggctgctgaacctgtcggcctgaatgtcctccccggaagctctggagtggcggggcactaataggctgctgaccagaataatactgctgagaactgctgctacctggagtaccatgagaggcctggagagctgactgataaggcctcgggggctggcccctagcatgtgaacccctacctccagacgaggtaccactgaaccgaccagaatgacggggcctcttatctgacccggtaccacctcccaaagacagtgccatctcaatccggcgggcaccatccgccgcctcttgaaatatgagatcactaccggcactcatagtcatctgcactcggatatccggggtcaatccatccacaaatctcctaaccctctcgccctctgtgggaagtataaataaagcatgacgggcaaggtccacaaatcgcgtctcatactgagtgacagtcatatatccctgctggagacgctcaaactaacgacgaagagcatccctctgagtgacggggagaaacttccccaaaaacaactccgcaaattgatcccaagtaagagctggcgaccctgcttgtctagtcagccagaaatccctccaccaagtcttggcggatccggccaggcggaatgtagcaaaatcgaccccattggtatccagaacacccatggtcctcaatacctcatgacaactgtatagatagttctgagcatcctcagaaggtgcaccactgaaagtataagggaaaagcctggaaaaacggtcaagtctccacaaggaatccgcagacatcgccgcaccatcactaggctggctcgaaataactgacggggctactactacaggctgagctggcacaactgacggaactggcacagctggctgaatcggcgcaactagaggaactggcaccacaggctgaactggggctacctgctgtactggcggtgcttctggagtctgaaatccctgcgccactagctcaggtgtgcgcacaacgggggtctgagtgcctccccctgtctgtgaagtggctgctgcggcggtggctgagactacctgtgctaggccagagcaaaccgacataatctgagctagggcctcctgaagacccgggataaccataggtacagctggggctggagtttcctcaacatgaacctggggctccaccactggtgctgctgctcggggttgagctctgcccctaccacggcctctagcgctgcctcgccctccgcccccagctggagctgctgctggggcctcgggttgctgatcagatgaagaggaagctcgagttctcgccatctgcgaaggaacagagtagaaagacaatcaatattgagaaatagagtcgcacgacaagaatgaataaagtgagattttcttaactctgtagcttctggggaacatgtacagacgtctccgtaccgctccctcagactctaccgagtttgtccgtgagctgtgagactcaagtaacctagtgctctgataccaacttgtcacgacccggattttcccaccaacgggtgtcgtgatggcccctactgtcggagctaggcaagccaaactaacatgcatctaacaattactaatcaacactaatcataagtaaagcagtaaaataaagtggaagtcttaattaatttaacaactgcaaaagcgcggaagaatttaatacaatcctctacccaagaaccagtgtcacagcactcacggactactaggagtcactacatacaaccgtttgaataaagaaatacaagatcgtctgtctgaatagataaacaaactgaatcgaagaagaagagactggatggcccacggacgccactgaactacctcgcagtctctggactgaaggctggctccctgactactgctgatgcgctccaaaagctgctcccggatctgtgcacaaaagggcacagaagtgtagtatcagcacaatgcgaccccatgtgctggtaagtgcctggcctaaccccggctcatgaggtagtgacgaggctagacaggacctacaacgttaacctgtgcaagatatatatatatatacgaaaacaggaataatactacaaagtaaacaagtacgggaggggacatgctataaggggaaaaacagttcaacagacaaactaatcagaagtacgtaatacggaactacaaattaagcagagaagtcagagatgtcgactacaatgcaaaacaattgcctttactttcaaacattacaacagtaatcaaacattgcacggcaacgaccatcgtgcttctcgtcctcccacactctcatatcatggcacggtaagacccgtcgtgcttaatcatttcaataacatggcacggaaagacccgtcgtgcatcaacagttcaataatatggcacggaaggacccgtcgtgcatgaacactctccctcgctaaatcatgagaactcaatcaacacataacggggaaaggatataaatgccatcaaagatcccgacaagggtagcaataacaaactttcatctcaaaatcaagtaagtaccaacaatccctaataagagccaataccccacaactaatacaagtcactacttattctccaccgaacacttcatatgaactcaatcaatttaagcaacaagtcttttcataatattcgaatttaaacaaggtaagacccacggtcatgcttgactcgggtgcataggtaaccgtcaccaaacctatacactgacccacacaacaggtagcaaataatattctaatcctagtccctcgaaccaaagttaggacaaacacttacctcgatgccgaactagcaattcaaagctctacaaccgccttttctttagaatccaactcccaaacaatgatatctaatcataaattacccaagtgaattaataaatgctaattaaactaatttgaatgcataaggatgagtttcccaaagttttaaccaaaaattcccaaaatgcccccgggcccacgtggtcgaaactcgaggttcgaaccaaaaccgggttacccattccctcatgagctcatatctataattggaattgaaatcggacctcaaatcgaggtccaaaagctcaaaatatgaaaaaccctagtttctacacaaacctccatttttaacccatgaaaaactttgatttaagatgaaatcatgttagatgatgatgatgattgaagaaaacaagtaaaaatggacttacaatcgaattggagaagaaagagttgagagaaaatcggacaagagggttttgggttttgaaataatgaaaatgagcttcaaaaatcgtttaagtaatttttacacaggtgcagacttcgcaaatgcgaagttaaattcgcaaatgcgaattggatgaagaaatgaggaaaagtcgcatttgcgataaagatttcgcatttgcgaaatggacaggggaaagagggaagtcgcaatttgcgacttatatttcgcatttgcgaaattggggctggggaagggaatgtcgcatttgcgacatatacttcgcaattgcgaaggctggaagagtaagggggacttcgcaaatgcgaagtctatctcgcatttgcgagatcgggctggaaagggaccatttcgcaattgcgaacaaggcttcgcaattccgaagcctgtaggtctgaggcatctgctgcaattccaaccatgcaaaaatgcatccgacacctatcaaaaacattcccgagccctcggggctccaaaccaaacatgcacactacctcaaaaataccctacggacttactcgtgcgatcaaatcgctaaaataacatcataatctatgggttaagccccaaaatcacaattccactctttaacacatgaaactcaagatttctatattcaagccgaaacacgtcaaacgacgtccgattcatatgaaattctacagatagcgcttaaacaacacataagacctataccgggcgtcggaaccaaaatacgagcccgatacgatagttttcaaatcaattttcattttccttttccttaattaatttcagaaacaattttcacgaaaaaattcataactcgggcctgggacctcggaattcgattccgggcatacgcccacgtcccatattttactacggattttttgaaattgacggaccacgggtccgggcccgtttgctcaaaatgttgaccgaagtcaaccttatcaatattatacttaaaatttcacaatttcaacacacaatttaactttcgcattgtaaaaactttccggcttcgcgcccgaactacgcacgcaaatcgaggcaacccctcaagaggttttcgaggcctcaaaagcacggagcaaaggagaattacggtgatgaccccattaggtcgtcacacatgtatattctgtcttgaattgctgtagttgtgcaaacacttcgggtgattgccgtgctatttcttatacctactagtcggtaggatcctagttaatcacacttgcacaagcatacacgtagctggacaccccattagaggtgaattccttccaatttggctaagggtggagatgcgccctcgtttacccattatatatgtgagagtggtcctagatagccagtgagttgtcagcaggatcgttagatttatggggtataggatgccaggtgttagacttcagatgttgggttttccttgtgacttgtggtttgtccaaggtgttggtaatgattgtgggaagagttgaataagaccctatgtaagcatcatcgtagaataagaattggtaacttactgttcttgctatgttgtgaccttaggctttggattgtgattttgccttcattcgtattatcatttattatgttctcgttgctacttgttctttttttctccttgttgtgaattgtagcacttttagtcatttatgcagtctctacataatcacatatatcgtcttcattattcacatgattatactgtttattgacctgtaggtgtcttgactgttcctcgtcactaccccatcgaggttagtcttgatacttactgggcatcgctgtggtgtgctcatactactcttctgcacacttttgttgtgcagatacaggtactcccattcagttctgtcatccttggaaggaggcttattcggtagagactccgaggtatgtctgctgggtctgcagaccgaggagtccctttccagcttctgcaatagtatagtcgtttccagtatttcgtttgtatagacattcttgagttagagccttatgtatttcccctagcttgtggtttgtgtgtttccgggttttgggagttgttctaaattttattgggtaaaatgtatgtgccacgcggcattgtatacatttttcttgttattcaattttagttgttacttttcataatgattgttgaattccgcaatgtgttaggcttacctggtctctccgactaggtgccatcatgacatgttcacagttggttaactagggtcatgacacctgcgctcttccagaattccactagaattttatctggccctgtcgctctgcgcctgcacatcttacgcatcgcctcttccacgtcctctaccgtaatccgcctacagtacccaaaatcccgccgactcttggagttctcaaactcacccagcacaatgcgtttattcccctcctcgttcaacagtttatgaaagtatgtctgccatcttctcctaataagtgcctcgtccatcaatacttttccatccttatccttgatgcatttgacttggtctaaatcacgggccttcctctacctctccttggccaatcggtacaaattcttatccccgcctttgcccctgcctttgcccccgagctcttcgtacaaacgagcaaacgccgcatctttagctgttgtaactactaactttgcatctttctttgcctttctataacactcccgataagtcattttttcctcctcgtttgtactctccactagcttcaaataagcagttttcttagtttccacttttccttggacctgtccattccaccaccagtcccttctatgacccccaggagagcccttcgtaacccctaagacctctgtagcagctaccctaatgcaattcatagtcgtgaatcacatactagatgcgtctcccctactcatccaggccctcatagccaagaacttcttccctaactcctgagccttgtccttggtcaagttacgccacttgatcttaggttgcctatacaccgccctcttcctcctactcctcttgatctccaggtccataactaggagcctatgtagggtcatgaggtgctcacttgggatgaccttgcaataagtgcgcagaactttatcgcattttctgcagagaagataatcaatctgagtcttgcccattgaatttcggaaagtgaccaggtgctcttccctcttcgcaaaactaaaaatcaacccaaaagtcgacccccgggcccgtaccttgaaacctgatttttttataaaatacgaacactcattctgatacgagttcaaaccatactaatattatcaaattctgatgccaattcgtccctcaactaatcattttacattttgaaagttttcttcaaaattcccgtttttcctcaaatcaaaatactaattaaatgataaaaataaagatggaatcatggaatataataaattctaggtgaataacacttgcccaattgattttcttgaaaaacccacaaagaatcgctccaaaccgagctctagaactccaaaaatattaaaaatggctaaccctcagaatagagtactttatattctgcccaagtatttgtacatcgcgatcgcgaagaagaaatattcaactgccagagaaagcactatgcgatcgcggataaaaaaaaatgtgatcgcataaggcaaaataacactgcctcacggaagagcactatggagtcgcaggagggaggaagcgaacgcggaggcaaagttttcccaagaatcgcgcgtgctttacttcgcgaatgcaaagaaataaatggtctgcctccactttacactacgcgaatgcggatgcactgacgctaatgcaaagaaggaaaccagatgacagaatcaacagctcaaaaacctaaagaaatggctcgtggcctatccgaaatgcacccgaggcccctggacctcaaccaaatatactaacacatcctaaaacactatacgaccttagtcgagacctcaaatcgcatcaaacaacgtcgaaactacgaatcgtaccatgaattgaactcatgaactttcaaatctttccacttctacaactcgcggcgaaacctattaaaccaacccggaatgacgttaaattttgcaagcaagtcccaaatgacataacgtagctattccaactctcagaatttattccgacaccgatattaccaaagtcaacacttggtcaaacctctcaaccttccaaactttaactttttctactttcgccgaaatgcttcaaattaccctacggtccttcaaattaaaatccggatgcgcacctaagtccaaactcaccatacgaagatgttagaatcatcaaaatctcatttcggagtcgtttacacaaaagtcaattccggttaactcttaatgcttaaatttctaaaattagaatcctttttccaaattgattttgaatcatccggtaaccgaacacgaacacacccgcgcgtcataacacataatataaagtttctcagggccttatgctgccgaactggacataaattttcaaaacggccggcccggtcattacaaaaatatatatttggctgtcttgacacaaaaatataaaagccaaactgtcacaacccaaaaatatcaccataggcatcgtaatgtcacttagtttctaagactaggtaagccgattataataacaattcgagcctttttttcaacagaatttaataaaagtgtcgaaactaaaagcggaaacaattattacaaccttccaagaccggcaatacagagtcacgaactctgactaaatacatgaaatgatctcaaggagcgaaatacagtactgtttgaataataactaacagtataataaaatgaaaagactccaagggactatgacaactaagcagctctaccttgaatccttgggatcaacaagctcactctgtccgagtctgatatctccaatacctggctctgcacaaaaatatgcagaagtgtagtatgagtacgccacagttggtatccagtaagtatcaagactaacctcggtagagtagtgacgaggtattgtcaagacacttactattcaaataacttgtacgcagtatataaaaataataatagaagaggaacatacagaaaagtaaaaatagttatctcatgataataattcaaccctcaaaatctagtaaatgcataaataccaaatactcagaatctcgtacgaaagtaccgaagccaatataattcaacaagggatacacacacatccaccattattctaccatgtaaatatcaataataataagtaaatatattttgcgggcgcacaacccgttctcaccatataatcatagtcataaaacacgggtctcaatccactatcatattctcatggcacctcgtgctcatatctcaatcatacctgtatggactactcacttgccaaaaatatcaatatatatgattcactcggacaactcacgtgaaaatcattatttattcacgacaccttgtacccacatctcatatcacaattgcacggacatttcatatgccaatatcataattattgtacacccatggcatctcgtgcccatatttcatatcactttttcaggggcagttcacgtgccaataacataatctgcccggcatagtcatagactcgccatttatacacgaatcaaataattatcaagttacgtactcgcgagctagcataagtagcatgctaaagtgtatgcatgtgcaattgtattactatagcccaagtcaataagaaatatcaagtctatcaattagctcaatgaaaaaccaagtcaagatacacaaggagaatcacaccataacacataaatcaccaatacaataatcccacatcatcacatataatttctgacattgccacccttatctctcctatagccacttgtatcactttgcccgcttgagagaaaaggctagcattgtatatacactatttctgtttatgtcagaagtgcccaaagctagaagcaagatttcgagtagaatattcaaagcttttgagtaagtaagatcgatggatttggaaaatcaggaatggagtcagggatgcccaactcaagataagtcctaaggttctattaaagtatcctttaataacatctctttctctagaatcctggcttgtagatctttggcaaataaacaggggttattttgtaattaggttgttctccgaacacaatatcaatagccacacttatcgcgcctataataccctccctcatcgctccgtatatgtcacgacccggatttcccaccgacgggtgtcgtgatggcgcctactgtcggagctaggcaagccgaacaatattcacataaccaattacaactaacaatttataatttaaaaacataaaattaagcggaacaatttaattaaacttagcggaaggctttaaataattcacatgaaagcaagcggaagaatatctgatacaacctctacccaagacagtgtcacagcgtacagacttctaaagagtcactacaaccaagcgtttgaaataaaatacataggattgtctgtttgaaactaataaacaaactaaagggtaggagaggctggagagtccatggacgccagtgaactacctctcagtctctggactgaaggctggctcctctatcagtgctggtgtgctccaaatgctgctcccggatctgtgcacaaaagggcacagaagtgtagtatcagcacaatccgaccccatgtgctggtaagtgcctggcctaaccccagtccacgaggtagtgacgaggctagaccggacctacagcgttaacctgtacagatatatatatatatgtgcgaaacaagaaaaataatgcatgaattaaacaagtataggaggggacatgctataggggaacaattcaatattttaaagtgcaactaaataaacagatattcaggaatcaataaggataaaccatcaagtagaagtatgtctcgtggtaggcgtaccacccgccctcattgcatcatatcttgtggtaggcgtaccacccgccctcattgtatcatatcttgtggtaggcgtaccacccgccctcatattatcatatcttgtggtaggcgtaccacccgccctcatattatcgtatcttgtggtaggcgtaccacccgccctcatattatcatatctgtcagctcaattcatttatacacaagtcctatctcagggaaaaacacaacaatttacacatatttatctaacccggcaagggtacagttataaccaataaatccccgcaaggaacacaagagacatatagaattcaaccttactagacatggcatttcactttaagttttcaattaagccatttaagtcatatgaagtccaacattttgctttcaaggatcaattcaatagctaaagtccacaatatagctttcaacaacttcaagtaaagacccacggtcatgctttgactcgggtgcataggtaaccgtcaccaaacctatacaccgacccatgtaacacatagcaaataacttcctaatcctaatccctcgaactagagttagaacaaacacttacctcaatgccgaactagcagttcaaagctctacaaccgccttccctttcgaatccaactccgaaacaatgatatctaagcaatattagattcaaaatcatcaataacaactcaataattcaactccaaagcctagaaatgaaatcccaaactttcctccaaaaattccaaaatccgaccccgggcccacgtggtcgaaactcgaggttcggaccaaaacccaatcccccatatccccacgagttcaaatatgtaattagtttttaaatccgacctcaaattgaggttgaaatccccaaaatcacaaaagccctagtttctacccatttcccattttctactttgatttcatgaattaaagagaggaagttcaataattaaggaagaaatgatgaaggaattgagttaggattaacttacccaaaggttgatgaagatttggaccttggtttttcgtcaatggagagaaaagagggtgagctcgtgtgaaaaacttgtgaaatggccgaaacactgttctggaaattaaataatttgctgggcaattttattcatcgcgttcgcgacatgaggtcgcgttcgcgaagcacacaggctggggaagcatcgcgttcgcgtgaagaggctgcgaacgcgtagaataaaaaggctgggctgcacgcttggcttatgcgaacgcggaggttaaccgcgatcgcgtagaagagaaggctgggggtccctgaacaagcctatgcgaacgcgtgagggactcgcgaacgcgtagaatggaggctgcaaggcatcgcgatcgcgtgggagtaacgcgaacgcgtagaaggaatttaccctcggctcagatgagcctacgcgaacgcgagggtcctatgcgttcgcgaagggcatttagggtctgcaacagaactgaaaatctggtgtgtttctaaggcaaaaaccactccgaaccacccccgaaaacactcccgagccctcggggctcccaaccaaacaccccaactaactcattaaccttccacaaactcgctcgagcgatcaaatcgctaaaacaacatcaaaaacatagaatcaaaccataaaatccttaagattcaactttagacttcaagttctcaaattagctattagggtccgaatcgcatcaaacgacgtccgaattcaaccaaattttacaggaagcgcttaaacgccatataagacctgtaccggacgtcggaaccaaaatacgagcccgatacgacatttaaaagccaattcttcattttcaaagacttaagatattttcagaaactattttcacataaaattccgtatcttgggtctgggacctcggaatttgattccgggcatatgcacgagtcccaaattttatgacggatatttagaaattgatacgacacgggtccgaacccgtttttacccaaaatgttcaccggagtcaactatatcatcattatacttgaaatttatcaattttaacacagaattcattcttcaacagagaaaatctttccggcttcgcgctccgactgtgcacgcatatcgaggcaacctctcaagaggttttcgcagcctcagaagctcggaacaaggagcatttatggtgatgaccccattgggtcgtcacaatctccacctctaaaacaaccgttcgtcctcgaacggacaaaagaaagaagtacctgagtcgggaaatagatggggataacggctccgcatatcggactcggactcccaggtcgaagcctcaggaggctgacctctccactgaacacgaactgagggaaaactcttcgacctcaactgtcgaacctgccggtctagaatagccaccggctcctcctcataagacagatccttgtccaattggacagtgctgaaatctaaaacatgcgagggatcgtcgtgatacttccggagcatggatacatggaaaactggatgcacagctgataaactaggtggcaaggcaagtctataggccacctctcccactcgctctagaatctcaaatggaccaatgaacctagggctgagcttgcccttcttcccaaacctcatcacgcccttcataggcgacacacggagcaatactcgctctccaaccatgaaagcaacatctctgaccttgcggtctgcataactcttctgcctagactgagctgtgcgaagcctgtcctgaataatcttgaccttatccaaggcctcctgaaccatatcaacacccaataaccgagcctctcccggctcaaaccaaccgactggggacctgcaccgcctaccatacaacgcctcataaggagccatctgaatgctggactgataactgttgttgtaggcaaactctgctaatggcaaaaactggtcccacgagcctccaaaatcaatgacacaggctcgaagcatatcctcaaggatctgaatggtccgctcggactgtccgtccgtctgtggatgaaacgctgtgctcatctgaacccgagtacccaactctccatgcaaggctgtccagaaacgtgaagtaaactgcggacctcggtccgaaataatagatacgggcactccatgaagacgaactatctctctgatgtaaatctcagccagtctctgggacgaataggtggtagcaactggactgaagtgcgctgacttagtcagcctatccacaatcacccaaactgaatcacactgcctccgagtcatcgggaggccagtaacgaaatccatagtaatcctctcccacttccactcgggaagctcaatcctctgaaatagaccaccaggtctctgatgctcgtacttcacctgctgacagttcaagcaccgtgccacataagcaactatatccctcttcatcctacgctaccaataatgctgtctcaagtcctgatacatcttcgcggcgcccgggtgaatagaataccgagaactgtgggcctccgctaagatcaaatcacgaatgccatcaacattgggcacacaaactcgcccctgcaatctcaatacaccatcatctcccagagtcacttccttagcacctcctcgctgaaccgtgtctctcaggacacataaatggggatcatgaaactgaagctcgcgaatacgctcaaaaagagaagagcgggcaaccgtacaagccaaaaccctgctgggctccgaaacatccaatctaacaaaacgattggccaaggcctgaacatctatggcaagcgatctctgaccaactggaacaaaggcaaggctacccatactagctgactttctactcaatgcatcggccaccacattggccttacccggatgatatagaatagtaacatcatagtccttcaacaactctaaccatctcctctgcctcatattcaactctttctgcttgaacaagtactggaggctcttgtgatcagtgtaaacctcacacgtcacaccatataaataatgcctccaaatctttaaggcatgaacaatcgctgctaactcaagatcatgaactggatagttcttctcgtgaatcttcaactgcctcgaagcataggctataaccttaccattctgcatcaaaactgcaccaagcccaacacgagaagcatcacaatagaccgtgtacggtcctgaacctgtaggcaataccaacactggtgccgtggtcaatgatgtcttgagcttctgaaagctcgcctcacactcgtctgaccacctgaataaggcacccttctgggtcaacctggtcataggggatgcaatggatgaaaacccctctacgaaccgtctgtaataaccggctaaacccaggaagctccgtatctctgtagatgaagctggtcgaggccagttcttgactgcctctatcttcttcgggtctacctgaataccctctgctgaaacaacatgacccaagaatgccactgaactcaaccagaactcgcacttagaaaacttggcatacaactgactatccttcagagtctgaagaaccactctgaggtgctgctcgtgctcctcctgactgcgggagtatataagaatgtcatcaatgaagactatcacaaataagtccaagaaaggcctgaatactctgttcatcaactccataaacgcagctggggcattagtcagcccaaatgacataaccaggaactcgtagtggccatagcgagtacgaaaagcagtcttagggacatcagacgccctaatcctcaactgatgataaccggatctcaaatcaatcttggagaaaaccttcgaaccctgaagctgatcaaataagtcatcaatcctcggcagtggatatttgttcttgatcgttaccttattcaactgtcggtaatcaatacacatcctcatagaaccgtctttcttcttcacaaaaaggactggagcaccccaaggcgacacgctgggtctaatgaaacccttctcaagcaaatcctgaagctgatctttcaattctttcaactctggcggcgccatgcgataaggagggatagaaatgggctaagtgcccggcgccaaatcaatacagaaatcgatgtccctgtcgggcggcatgcccggcaaatcagaagggaacacctcggggaactcccgaacaatggggacagaatcaatagacgggacctcagcgctggaatcacgagcataagccagataagctaagcaccccttctcgaccatacgtcgagccttcacataagaaataacactacgagtggtacgaccgggggtccctctccactctaatcggggcatatccggcaacgccaaggtcacggtcttggcatgacaatccaaaatcgcatgataaggagataaccaatccatcccaagaataacgtcaaaatccaccatatccagcaacaataagtcaacacgggtctcaagacccctgaataccacaacacacgagcgatgaacccggtccactactatagaatctcccactggagtggacacatggacaggaatactcaaggcctcactaggcataaccacacaaggcgcaaaatatgatgacacataggaatacgtggatccaggatcaaataatactgaggcatctctattacagaccagaatagtacctgtaatcacggcatcagatgactcggccttaggtctggccggcatagcatagcaacggggctggggcccacctccctgtatgacatctctaggctgatctacaactgcctgacctctaccgcgagctgcctgagctccacctttaagacctctgcctccacctctatgacctctacccccgcctctggctggctgggcaggctgtggggcaggtggtgcctgaatcatgggacggggtccctgctgctgcgaactgctggaagctctggggcaaaacctggcgatgtgtctagtatcgccgcaagtataacaagctctggtctgctgagcaaatcgcaaaggagctgcactgatgggtgcggaaggcgaactatacaactgctgatcggagggctgaacctgtgaaccacgcccacctggggcaccctgagaagtctggagagctgactggaaaggcctaggaggctggcccctagcatgtgcacccctacctccagatgaggtaccactaaactgaccggaacgacggggcctcttatctgacccagtaccgcctcccaaagacaatgtcatctcaatacggcgggcaccatctgccgcctcctggaaagatagaccaccaccggcactcatggccatctgcacccgaatatccggatgcaacccatccacaaatctcctgaccctctcgctatctgtaggaagtagcactaaggcatgacgagccaggtccacaaaccgcgtctcatactgcgtgactgtcatatatccctgctggagtcgctcaaactggcgacgaagagcatctctctgagtaacggggagaaacttccccaaaaacaactctgcgaactgatcccatgtcaaagctggagaccctgctggcctagatagacagaaatccctccaccaagtcttggcggatccagtcaggcgaaaagtggcaaaatcaactccattagtctccacaatacccatggtcctcaaagtctcatggcaagtaaatagatagttctgagcatcctcagaaggtgcaccactgaaggtaagagtaaataatctggaaaaacggtcaagcctccacaaagcatccgcagacatcgccgcaccatcactagtctggcccgcaacaactgcctgaactagcacaactgaaggagctggggcaacctgctgtacaggtggtgcctctggagtctgaagtccctgcaccactggctcgggtgtctgcataactggggtctaagtacctcccccagtctgagaagtggcaactgcggcggtggctgagaccacctgtgctagactagagcacgctgacatgatctgagctagggcctcctgaagacccgggacgaccataggaatagctggagatggagtccccccagtctcaatctagggctccacctctggcactgcggctcggggctgagctctgcccctgccacggcctctagcgcggcctcgtcctctgcccctaactggaactgctgctggggtatcggcctgctgatcagaagaagaggaagctcgagttctcgccatctgcgaagaaacagaatagcgagacaatcaatattgagaaacagaatcgcacgacaagaatgaataaagtgagattttcctaactctgtagcttctggggaacaagtacagacgtctctgtaccgctccctcagactctaccgagtttgtccgtaagctgtgagactcaagtaacctagtgctctgataccaacttgtcacgacccggatttcccaccgacgggtgtcgtgatggcgcctactgtcggagctaggcaagccgaacaatattcacataaccaattacaactaacaatttataatttaaaaacataaaattaagcggaacaatttaattaaacttagcggaaggctttaaataattcacatgaaagcaagcggaagaatatctgatacaacctctacccaagacagtgtcacagcgtacagacttctaaagagtcactacaaccaagcgtttgaaataaaatacataggattgtctgtttgaaactaataaacaaactaaagggtaggagaggctggagagtccacggacgccagtgaactacctctcagtctctggactgaaggctggctcctctatcagtgctggtgtgctccaaatgctgctcccggatctgtgcacaaaagggcacagaagtgtagtatcagcacaatccgaccccatgtgttggtaagtgcctggcctaaccccagtccacgaggtagtgacgaggctagaccggacctacagcgttaacctgtacagatatatatatatgtgcgaaacacgaaaaataatgcatgaattaaacaagtataggaggggacatgctataggggaacagttcaatattttaaagtgcaactaaataaacagatattcaggaatcaataaggataaaccatcaagtagaagtatgtctcgtggtaggcgtaccacccgccctcattgcatcatatcttgtggtaggcgtaccacccgccctcattgtatcatatcttgtggtaggcgtaccacccgccctcatattatcatatcctgtggtaggcgtaccacccgccctcatattatcgtatcttgtggtaggcgtaccacccgccctcatattatcatatctgtcagctcaattcatttatacacaagtcctatctcagggaaaaacacaacaatttacacatatttatctaacccggcaagggtacagttataaccaataaatccccgcaaggaacacaagagacatatagaattcaaccttactagacatggcatttcactttaggttttcaattaagccatttaagtcatatgaagtccaacattttgctttcaaggatcaattcaatagctaaagtccacaacatagttttcaacaacttcaagtaaagacccatggtcatgctttgactcgggtgcataggtaaccgtcaccaaacctatacaccgacccatgtaacacatagcaaataactttctaatcctaatccctcgaactagagttagaacaaacacttacctcaatgccgaactagcaattcaaagctctacaaccgccttccctttcgaatccaactcccaaacaacgatatctaagcaatattagattcaaaatcatcaataacaactcaataattcaactccaaagcctagaaatgaaatctcaaactttcctccaaaaattccaaaatccgaccccgggcccacgtggtcgaaactcgaggttcggacaaaaacccaatcccccatatccccacgagttcaaatatgtaattagtttttaaatccgacctcaaattgaggttgaaatccccaaaatcacaaaagccctagtttctacccatttcccattttctactttgatttcatgaattaaagagaggaagttcaataattaaggaagaaatgatgaaggaattgagttaggattaacttacccaaaggttgatgaagatttggaccttggtttttcgtcaatggagagaaaagagggtgagctcgtgtgaaaaacttgtgaaatggccgaaacactgttctggaaattaaataattcgctgggcaatttaattcatcgcgttcgcgacatgaggtcgcgttcgcgaagtacacaggctggggaagcatcgcgttcgcgtgaacaggctgcgaacgcgtagagtaaaaaggctgggctgcacgcttggcttatgtgaacgcggaggttaaccgcgatcgcgtagaagagaaggctgggggtccctgaacaagcctatgcgaacgcgtgagggactcgcgaacgcgtagaatggaggctgcaaggcatcgcgatcgcgtgggagtaacgcgaacgcgtagaaggaatttaccctcggctcagatgagcctacgcgaacgcgagggtcctatgcgttcgcgaagggcatttagggtctgcaacagaactgaaaatctggtgtgtttctaaggcaaaaaccactccgaaccacccccgaaaatactcccgagccctcggggctcccaaccaaacaccccaactaactcattaaccttccacaaactcgcttgagcgatcaaatcgctaaaacaacatcaaaaacatagaatcaaaccataaaatccttaagattcaactttagacttcaagttctcaaattagctattagggtccgaatcgcatcaaacgacgtccgaattcgaccaaattttacaggaagcgcttaaacgccatataagacctgtaccgggcgtcggaaccaaaacacgagcccgatacgacatttaaaagccaattcttcattttcaaagacttaagatattttcagaaactattttcacataaaattccgtatcttgggcctgggacctcggaattcgattccgggcatatgcacgagtcccaaattttatgacggatatttagaaattgatacaatacgggtccggacccgtttgcccaaaatattgaccggagtcaactatatcatcattatacttgaaatttatcaattttaacacagaattcattcttcaacatagaaaatctttccggcttcgtgcccggactgcgcacgcatatcgaggcaacctctcaagaggtttttgcggcctcagaagctcggaacaaggagcatttatggtgatgatcccattgggtcgtcacagtataatagcctcccttaccgttccgtataatagccacacttatcactccgcccaaataatatcacaacacatataacaatattgaaatgtcacccttatgcccgcataatatcaacagtggaatgccgcccttatacgctgcataacaataacccaaatcacataacaattcacactgaatattatcagaacaacacaacataatcaactcgtatgacacattgccaataggctaaaacctttccaaaggtacaatgaaatcaattaattttacaatagatagcccacaactcaacacaacatatataaaaatcttagtatcaacaacatggatggaaaagtaactcagcaaagaataacaccttttctaatctaaattttaaataaatagattaatgcctcttgagaatttttattcttatttaattatttaatttgctataagtgtcaataatgaaagtatttcctcgaaatggaaacccaactaagcacagaattcacgtaaaagtcaaagtagtaaccacatcaaattatcatataaaacaaactcggcaagcaaggaatgaggcacgtaacaaaacgtctaaataaaacacgcaatggtgaacacaatcaataaaggaggtaatatgtgcccacaatcttcagttaatacataaaaaatgcctaagaatttagaatttgcacatataagccgagtacgtactcgtcaccctacgtacatgactttcacattacaccaaattctacatacgactcaatgcctaaggagtaattccccccttaaggttaggcaatatacttaaatttacgaagtttggacgatattccaaaatggccttctcgcgtgaaatgacctccggacggttcaaatctagccaaaatatttacataacatcattaaaatttatcaaatataattttggataataaaacatcgactttacattttacatcaaaaagtcaactcaaaagtcaacaatggggcccacatctcaaaatctgataaaaattataaaacccgaacccctattcaaccacgagtccaaccataccaatattactcaaatttgaccacaactcgtcccttatatcctcaataaaatctatgaaaatttctaccattttcaacctaattcactgatttaattataaaaacaataataaattcatgtaatttaacaaaaaaacgagttagaaattcctaccccaatattttccttgaaaaactctcaacaaattgtcttacccggagtttcttggtccaaaatggaagaatgggacgaagtctcatttttggactttattctgctgtacatgggttccttctttgcgttcgcgacctttcccttgtattcgcgatatacaaatttctcaataaccattttcaaactcttccagatagcctctagtataatggtcataattttttgtacaaaatttcaaatgacaaatggtttgattttctgaaaactagatatcaaggattacaattttatttttggatcatctccaaattccttatagattgcgagatataagctttcaaagtcagacaacggacatcgggaattccttcttcgcgaacgcgaagaacaacattctagcagccaaaaccttcttcacgaacacgagaggctcctcgcgaacgcgaagaacaaaaccagacaacagaaaaccagcatccaaagcagcccaaaatgatccaataacacccaaaacacacccaaggccctcgggaccccaagaaaaatataccaacaagtcctaaaatatgatacaaacttattcgaggcctcaatccacatcaaaccacgctaaaaccacaaatcgcaccccaattcaagcctaatgaaagttacgaaatttcgacttctaaattcgacgccaaaacatatcaaatcaagttcgattgactcaaattttgcacataagtcataaatgacataagggacctattgaaatttctggaatcaaaatccaaacccgatatcaacaaagtcaatccttggtcaaacctctcaaccttcaaaaacttacccaaatccggacatatgcctatgtcaaaaatcaccatacgaaactattgaaatgatcaaaacgtcattccagagacgtctacacaatagtcaaatctctggtcaactcttttgtgatgacccgataggtcatatagatttttaaaccttaattctatattttggaacctcaaataccccattttagcttttttcaatttgcgtgcgtattccgagtctttttcggaaggcttttatgttaaaacttaataaaaattatgaaatttagccttaaaaattcatttcagcttacttcggtcaatattttgagcaaacagacccggatccgtatttttacggttctggtggttcttatcatgatttgggacttgggcgtaactccggaatcaaattcggaggtccctagctcgagttatcttattttgttgaaaatttgaagtttaaaggcaaaatgaatttcaaggtttgaccgatgtttgactttattaataccgagtccgtatattggtttcagaacttggtataggtccattactatatttatgacttgtctgcaaaatttagtgagaaacaaagttggtttgatgtaattcggacgttcggttgttaagatagaaattctaaagtttcatcgaaaattttatttgacttggtgtccgattcatagttctaggtgttatttttgcgatttgatcgtgcatcaaattcgtatgatatttttggacttgtgtacatgtttggtttggagctccaaagactcaggtgagtttcagataggctgcgtagtgagtttagacttaaaaattgctggtgttcttcattttctagtgcaggcctcagacctcgcaattgcgaggtcaggttttgcatttgcgatatggcagactacttgtcaagttcgcatttgcaagctatttcctcgcaattgcgaagaataggtgggcaccaatggttcgcaatcgtgaacaatttcttcacaattccgaagtggggctggggagcagtgctttcatttgtgatcaaaatgattgcaattgcgaggagttcatgttcgcagttgagaacaaaccatcgcaattgtgatgtcaacagagatgggggacgttcataattgcgaagaatttctcgcatttgcggggttcgttgtctcaaattttcattctcccatgttttcaaacctagaaaccttataggcaatttttccatcaacccttcttccccaattcattggtaagtgattctaacctattttctttcaatcttccattaaatttcataatattttaacctaaaatctaggattttcatggtggaaaatgggggtttgggtagaattagggatttttataaatttggaatttagacctcaaattgaggtcggatttcgaaacaaattacataatcgggcttgggggtgaatggataatcgggtttggaccaagcgggctttggagttgaattttgttgactttttcaataataacctaaattgaatcttttgcattcgtggatagtccctaaggcttatgcttaatcatttggttgataatttgctagattttgttggttcggaggcttgttcgaaaagcaaagttatggttgagctttgagtcgatttttggagcgaggtaagtaatggttaatcttgtcttgagggattaggacttgtttgcctattttctacatgtttaaatgttgggtacaacgtatatgtgaggtgatgagtacttatgcgttgttgttgggttaaagcatgcgggttggacttgtttcttgtaatttacttcctcctttgattataatattcatgcttagactagtttattactaaattgaccgttctttacgcatttatggctatttgtgataattgagtaccgttgttgacgtaaggtttattcttacttattctatctcccaaattgttatattttcaatgttacatagtaaggaagagagttatagcgcgaagggtgatgccgtgccgtatttgagagttaaagaacaaagggtgatgtcgtgtcgtatttattattttataataaaattgagagtaaaagcacgaagtatgatgtcatgctgtatttatcattttatggagagattgagagtaaaagtacgaatggtgatgtcgtgcctttattactatttgatggtgaggctgagagtaaaagcacgaaggtgatgccatgcagtttctattcattatgttatccgtctctttggttgaaggtttatttactgcttcatgttgtcatttcctattgtagtactgtatttgtacccctctcacatgtcccctcccaatagtacatgttaattatttatttgctgttatgttgtacgtatatcttcgtttgtacatgtttaattacgtcgatgtctcatcatagcctcgtcactacctcgttgagattaggctcgacacttacggagtacattgggttagttgtactcatactacactctgcacttcttgtgcagattttggtactggtcccagttgtccgtgaggcgcatcaatatctaggattagcttatttggagacttgaggtagatctgctggtatccgcagactttgaagttcccttcaatttttcctatttactgttcttttattcgagacagttgtacttatttcaaaccctatatatagaacttctagaagctcatgcacttgtgactccagatctgggttgtacttagatattgttgattattatgcccctccgtactttgttttagtttcatttcggtttaattggtttgacttattgaattgattaaaattggcttaaagattctctaatgttggcttgcctagcaagtgaaatgttacgcaccatcacggtcccgaagatggaaattcttggtcgtgacatctttttacttaagcttctaaaacaagtacctcttcgaaattgatcccaaatcgtccgaaaaacaaactcgaccacccacacaagtcataatacacattacgaagctactcgagatcttaaaccgttgaacgagacgttaattcttaaaacgtcaagtcgtgtcgttacacaaatagtcatatgctcttcttttgaaaaatctcccctttaataaaaaaaacacaagattttcaaaaagccgacaccatatgtgattgtaaataatgttgttccacataacaatatgtgtttatacaatgcataggccgacaccattttaaaaaaaatgaaaaataaatactagctagtaatttattactggaaaccaacagtcttagacctaattaaacacagttactaacaaaattgtggcagtaggcacacacctctaaggaaaactgatcaaacaccttaactataaggggttaaaaggggcaggatcatgctttcaagaaacaaaacatcagctgaaacaagatcaaagctatactcaatcaattgcattaagttttttttttttctgaaaaagacatatagtacatatgtattactagtcgttacaaaagacatattgaagtaaggatttaagtaaaatggtcaaacactttatatgaatagacgataactaacttcaatattcttgaataagattcatgtacacagaacatatactgacctgaagtctaagtcactagttatatgaataaaacaaccctagttatatgaatacaataaccctagttatatatccattcatattatttgctggaccaaagtggaataatttggataatcagctcaaataaatttctcttgaaaatcaaagccatttacaaatactaggtgtgacagtactctagtatcttttaaattcccttatgcaacggcggaattaggtggcgggaatgaggttcagcagaaaccccttcgccgaaaattataccgtataagattaaaatatttctctctctatataacgtattgaatttccttaacatttttaggtatttaccttcttttaaatttttaaattcccttggtgaaaatcttgctttcgccactgactaacgcgatgctctagataaacttttgatgcagcaatcaattgaagcaacaatactgaggccaaggaagtcatgttgcatggccaccatttactgcgaaattttggtagaatcatcagacttggcaaagatatattatattataggaaaaataatattgtataactgttctcaaaataatagtaaaatatatatatatatatatatatatatatatatatatatatatatatatatatatatatatatatatatatatatatatatatatatatatattgtatattatatacaaaaattatacaagttttatacactttttcggctaccaaatataaatagtttctggtgcggcctaaaacaaaggaccatatcgagaaacaatcaaaaaaaagttttcaccttcaattataaacaatacttcgctagaaaatttgaaagagagagttagaataaataggattcatactatctttcttccgaatactgattaccaagaatttgaacaaaaaatggatacggttgctaaaaaaccattatcaacagaaattgacgagttcttaactttatcaatgaatttggtaacgaactaaaatcgagtttaaatttgaaagacctttctttattttcagaccaagaacatggaagagtgaattcagataaatttgtaaaatttgtattcaatgcagttgatcctgacaacatctggaaaaaaattgattggtataaaagaaatcagtaaaaaaatacctcgttggtcacataaattaatcatcgaattgaaacaacaatcgggtgactatcaagagggcgtaccactggatcatcaaattcgttcaagaaaagccggactacctgcacctggacagaaagaccctatgaagcttcactgttccctgggattggctttgggcctttcctctgcagcttaagtggaaggcgaagaaggcctccttccggggggcccgagccataagtgagataccactctgcaagggctagaattctaaccttgtgtcaggacctacgggccaagggatagtctcaggtagacagtttctattgggcgtaggcctcccaaaagtaacggatcggcatgcaaaggtttcctcgggccggatggagattggcactcgagtgcaaaggcagaaaggagcttaactgcaagacctacccgtcgagcagggacgaaagtcggcgataatattcctatattgtaactattgttcaacctgtaattatggcctttatgggtactgttgtgtctaacgcttggcctttagattatacttcttccgtttcaatttatatgaacctatttaactgggtatgatatttaagaaaaaaaaacttttgaatttgttgtgtaaaatgaggcacatattttgtctcactataaatcatagaatataaaggtaaattatttccaaatatgaaaacaaattatttttttggtgtattaaaaaggaaaatagatttaggtaaattgaaatggagtatatgacaatcctattccggttttagtcaaatttcaattttgggatactaaatatcaagtggaaaaaaagaaaaaaaaactagcttctattcagtttccgctagttacatttttagttgggatttttacctatatataccatataacaaaccttattacctctcatgtttaaggtttgtgtttattacatttaagcataccatatttcaatttatataccataattcaaattaagggtataattattgcttcatttattctaggcatgattttaggaacatatattctccaattgccacccacgccgtgtcgtatgaagaaacagaaatttcaactttatggaacagtcccctaattctttctttggtcgcttcattgctctgcattcagttttacaagattaatcatctcaactgatagtgagtgtgtgtgagcatgtgttgattagtgagaaacatacttgaagagcaaaatcagttgatggtgctgtttgggtggcatcaattagacaagctgctaaaacaaattaagaaatgaccgttacgttaaagaagagaatgagaaacgtaatcacttccaatgcaacttactatattatatacatgtcacttatatacatgtcctatggtcaagatatttctcgctcaaatttgtttaatatgtcaacgctaacaggggaagagagttgtaagcaactttcataagattgtagtttaattgtagtataaatgtagtaattttgtagatactcttaaaaataatacaactttatacaatacttaaactgatttgtagtttatttgtataaattttatctacaagatatctacaatatgaatacatttaattttaatatctcaattcccatttcaattgtagcataattggcattttcgacacaattgtagaaaacttgtagaagttttagtcttcccaatctacaatttatctacaaattatctacaatttatctacattgtatctacaatttatctacaattctacaatttaactacaatttaaccacaatttctggaaaaatatgtcttcttcttcttcaacgagtttcaatctgaaattcagtcaaaaccaagtctaatcttcaccaaaacccctcaaaattgagatataaactcctaaacatatttcgaattaattacaacaacacccaatccaaacaaataatgatttttgaaaatccaaatttgaattcaaagctttcaagctttttaatggctatcaatggtggaaaatatatggagaaggagagaattacgctgtaatggatttgcttccgttttaaatttcgaaattaacggtgatagaatcaccattaaatatgattcctacaaatttggcgcctttttagggtagaatctacctatttttggtttggtacagattttgtaatcaaactatggactaggcgggtaaataccaaattatgaacatttttggtaataaggtttggtatttggtatagataggaaaaaatccctttttagtttgtgttttgttttgtcctagctgtttcaacttgcaataaagtctaggtcgacgtctagtcttgtagtctattaatactagatgaggaaaggcccgtatacgggcccaacattgcagttttattaaaattattatttgttggtatttagttaattaacttttgaggtttaaccagctatattttctaaaattatttttgaatataaaaacatttagtttgaaatcgtcttcaaatagtatggatagatgaaaattatttaatttttattttcaaatttctttaagatactatgggcaaatatgaaaattatgtaaatatcgatacttctttttgttgttgtattatttaaaaaattaattttattttctcaatggaaacttttatttgaataatccaaaattaataattttaaaatgagtaaaagattggaaatggtatttgcactgcacaaacagtctaatcaatacatgtatagtgcatttaaaggagagttgtggctagagaaatgtggggtccacgtgtatttgcatttaaaaaatgcaaacatgaaatttttatgaaataatatatatgccattggtcaatcatctttccttttctatataatagaaatattgtgttactgtatgtacttttaatttgttgaataagaacaaattaagtaatactccttatgttccattttatgtgaacatatttccttttttgtcatttccaaaaagaatgaaccctttttaaatttggtaacaatttagcttaaagttacaactccacccttaatgagaaacttttataaccacacaaatactctgggccctatttggacttgtttaggaccacaaattccaaaagtcttcatttttttcttaaactacgtgtccagtcaaacaacttcacataacttggaacggagggagtattaaagtgtccaatcaaagcaaacctattagttgaaatgtcaaaagttggtatcaaatttagggagttatgtaggctcccgttttatcatagattttggctattatttttcaagttgaaattttgttcaagttcctaataattgatttataacaacttttgggtaaaaaatttctttcactcaaaaactttatgtttttctcaaataaaatgtacatctaaacacaatttcaactttcaaatattattttttaacataactctaaaaattcttttttttcaaattttaattaaatatatgttcaactatgtattcatttctgcttatgtttatcatgcattttcataagtgaatttcatacttatctcatgcaaacacttatactataaaagacataatattcctaaatgcaacatgtgatacgagatcattacattgttagtgtaccttattattggtaaattttgaactttatcaaaaataattaaggaactaatgatatgcaataaataaataaagttgaaaaaaattaaacttgactcaagacacattatggaagttagcaatagcattgttgtttgtctcctcaaacgatcatagaccttcaggataattcatatttcaagactagctattttttaagagttgaattaagtttaaaattcatttcattgtccgagcgtgcggcgtgttaagcaggggctgaggtgtgttaagcaggaggtagagcattagttgcgggttcaaacgaactcagcttcaatcttatatttataataaaatatattaaataagtataaatatttaattacgaacccaataactaagataaactttaagttggtgataaattaagaatttataaattttaattcctaatttcgcctctagtgttaaggtgtcccacatttgttgagggatgggtttttctatggtcttgggcaagagttggagtcactcggccaccaacatttggcccattgtttcctgttaaaaaaatgggatttttacctatgtataccatatagaaaaccttattaccttccatgtttaaggtttgtgtttattacatttaagcataccaaatttcaatttatataccataattcaaattaagggtatattaccatcaactccaaaatccctcacgatttcaagatgcaagtaagacttccacccattgatacatgctctataaagaaatactagtaatcatgccctctaataattctctctttttcagaggaatctggtgccatttcttttaggggtcgtttggttggaatatagcttataccggtataagttataccggtataagttatactgggataagttatgccgggattagttatgctgggactgttgtttattcattgtttggtatgttgtattaagaataacaattgcataatttctaagcagaaggtataactaataccggtattagttattccaccttttataaggtataagttataccggtgttaaaattaacaccggaataacttataccagattttccaaccaaacaaggtataagctggtattaaattttaataccagtgttatttggtcttataccccataccaaacgaccccttattagtttaaataaagagaaacgacagtatcactttgtctgcgacatttccatatagatttcaaaattgcgactgttcgaaaaaaaatatttatcaaacatggacgctctagaaacgggtacagaattctgccaatttaaaaacaatacagctttatacaatacttaaactgatttgtattttatttgtagaaattttacctacaagatatctacaaattgaatacattgaattttaatatcccaatttccatttcaattgtagcataattggcattttcgacataattgtagaagacttgtagaagatttagtcttcctaatctacaatttatctacaaattatctacaatttatctacaatttatctataattctacaatttaactacaatttaactacaatttctggaaaaatatgtcttcttcttcaacgagtttcaatctgaaattcagtcaaaaccaagtctaatcttcaccaaaacccctccaaattgagatataaactcctaaacatattttaaattaattacaacaacacccaatccaaacaaataatgatttttgaaaatccaaatttgaattcaaagctttcaagctttttaatggctatcaatggtgaaaaatatatgaagaatgagagaattacgctgcaatggatttgcttccgttttaaatttcgaaattaacggtgatagaatcaccattaaatctgattcctacaaatttggcgcctacaaatttggcgcctttttagggtagaatctacctatttttggtttggtacagattttgtaatcaaactatgaactaggcgggtaaataccaaattataaacacttttggtaataaggttttgtatatggtatagataggaaaaaatctcttattttaatgggaaacaatgggccaagtgactctaactcttgacgtagataattggtggcctagtgactccaactcttgacgtagataattggtggccgagtgactccaactcttgacgtagataagtgatggccgagtgactccaactattgcccaagaccatataacaacctatccgtcaataaatgtggggcaccttagcaccaaatacagagctaggatttagaatttataaattctcaattaatcatgaactcaattttatcttagttattggttcttaattaaatatttatatatattttatatattttctaatacaaatacaaggtttaagctgagttcgttcgaacccgcaactaatgctcttactcagcccctgcttaacacctccgactctcgaacgaagaaatgaattttaaacttaattcagctctaaagaaaagctagtcttgaaatatgaattatctcgagagtctatgtgttagaacaatcgcagcggaagcaagcaaacaatccaggcatcaaatacatgtaaactagacaacataataaaacgagattaaaagcactaacctcttaaagtaattgcacaaaccttccaagcagcaagaatccagggttgcggtcttctgctattagcctagaaaaaacccttggacgtttttgctattgagtgggcaagaacaatacaactgaaaggtgagtaattaggagaaactagtcttcctttaatagagaactttttggatgaaaatcctctccaaaaacgtgtaggattcttcttctccaagtagaatcctactccaactctattagatgacttttctctcaagtttctttttacccaagtttgtccaggtttttactaggtatagcagggaccacagaaataataagaggctactaattatagtattaattcggaattagcatgaattaattcttactataattaattgcaatttattccactaaaaaactgcaattgaactcctcaatatgaatttcgaaaattcattaacacttattttaactcctcatgttaagattttaaataccagttaattaaattaaactactgaaaatttaattcaattaactaattaaatcctttataattccgcttaaattatttcatgtgacagatacaaaatccaccggccgggttttcacatgaaaacttataagcttacataaaggggtatcatcaaacccaaaaccgagtcatgaattctatcaactaattattattcacaaatgctattcgttattgtccaatctattaggtatatactaactctaaatagagtcgtaccttttgataaatcaaaacaataaacaaattacattgatcataataattatatcaagattaggagtataagctcatttaatgaattagagaaaatgtattatatattcagtacaaaaacatcttttctctacttggtccgttcaatatacactaagtatactagcacaagaagttggagtaaaaccactcccataatcaagataaattatacaataatcttgtgctacaatcatcaagacattttgtccaataatatctttgattgtgaacatagtttattaattatgagaaccaacaatttaatcttctgtgcatgagctaagactccatacactaaattgtctactacataactaaaaggacacacatataacaaatgatctatttaaaatagtactttattgaattgaataaattaaacaaacaattgtttcataaagaataaaacataatactatatctaaaccgcatggttaatagtatatcccaacactatgatcatataaggagacaaacaaccgtaattccgccaatatgagaataatgttattgctaacttctatcgatgaaaggataagatggatcttgaaagaaacgcgtttcccataatgtgtcttgagttaagtttaattttttcaactttatttatttatttttgtaacgacccgaccggtcgttttgagctatagcgcggcgttcagtagtctggggccatgagcagcttcatttcaggtatattaacttgtacacgtgctcggaattgaatttcggtaagttcagaatggatttggaaggagaattctcattttgaaaacttaaagttgaagaataaactagaattggaaatttgagtaaatgacctcggaatcgggatccgaaggttccagaaggttcgtatgatgatttcggacttggacgtatgcccggatcgggttttggatgacccaggagcattttggcgcctagtgtggaagttagcattttagaagaaattgcatcagtttggcttaaagtgcatttcagtattattgacacccgtttgggatttcgagattgggagtagctccgtatggtgattctggagttgggagcacgatcgaaagtaaattcagaggtccgtaggtcattttggagccatttggctaaagatagaaatttgaaggtttttgagaagtttgaccgaaagtgaactttttgatatcggggtcggaatccaattccgaaagctgtagtaggtccgtaatatcaaatatgacttgtgtgcaaaatgtgatgtcaatcggacgtgatttgataggtttaagcatcgaacgtagaagttggaagttctaaagttcataaagcttggattggaggttgatgattgattttagcattttgatgtgatttaaggcctcgagcaagtccgtaatgtattttgggactggttggtgttattggtcaggatcccgggggcctcgggtgtgtttcggcttgtgttgcgctcttatttgatgtttcaacgccgtttctttggacataaaggggtatcatattaatcaaatgagctccaaattgagtttttattgaaccattagatctgtatcgtaattttggagccatagcaaaaagaatcgtcgaatttagacatcgtatgaggaagttatgcttgttttcgtgtcgaaaaaagtgctggttgctgtcataaccgcaaaagcggaaattttccgcagaagcggaaccgcaaaagcggtaaattttctgcagaagcggaaccgcaaaagcggaaaatttttcgcagaagcaaaacagcaaaagcggaaattgctggaggtagaggggtttctttaaaaatcgaagtttggctcatgttcactttatttcttccatgggagacgattttggagcaacattggagagtcattttcgtcaccaagcataaggtaagtgatctctactagttttgagtatatacatcaattacgtatggattttagcatgaaaataggtaaaaaactgagggttagaggaagacctagaaatattttgttattggatttttaccacgaatttgtgcatggaattaggagtaaattatatatttgagtttttaaggtcatgggtaaactttatcttcaaaaaatttcggataccgggcacgtgggcccgagggcgttttggtcaacttttcgttcgaggttagaaattgttataaattgggttgtaaagtattattgagcatatattaatggatttgtataatcgttggctagttttggagcattgtgagttggttcaagtcctcggaagaatgtagaatgccgattatgaatcttcggagcgaggtgagtctcctttctaaccttgtaagagggaattatccccataggtgagttaattggttatgggttcctatttgtgagggctacgtacgcacgtgataacgagaatccgtgcgtagctactattatgctattgtccgggtagtttaggacccaagatcatgttatacttgaactatttgtgaacttattgacaacttgaattgcttaaatctcctcgaattagcaaatgaatttctaaaagatttaaactcaattttcttaattattaaagagaattagcctttatttatatatttgctccatgttgatttcttgatggaccgtctgcctgtgtctgtttatttttggaacggaccgaacgcctcggcagattaaatagatgcatctatggtacgggcccttcgaccctcggcagtgcacaaatgtatatttctgttggagcgggccgtcgacctcggcgtgatttgcgcatgcttatatggctcgcctgaaatatttaaatgttgatattgcctttttggcctgatataaattgctaagaataaatgataagtaaatcatgaaaaccccttattacttgaaaaatgtgcttacatgtttacccgctttgggatgttaaattgctatagaaatccatgttttcctcacctttttagtatattattacttgaccactagcaagtgttaaagtcgacctctcgtctctactttttcgagattagacgagatacttactgagtacacgttgttttcgtattcatactacacttgctgtgcatttttattgtagaggtcgacttgtggctgggtggcatagcagcatgattgacacagagactaggtgagctgcatttcctcgaggcgattccgcagctagtatagtctctttcagaggtctatttactttctgtccaactgtattccggacggatgttgtattttatttctcttatcagtagatgctcatgcacttgtaacaccgggttctaggatggtttgaagtattgtattaattgcttaacttttaaatttgatttgaaaattatattctttaaaatttctaaataatgaaggaaaaatcctgtatttcaaaagtattaaaacgagattttgattaagtaatttggttggcttgcctgatagcagtgtccggcgccaccacgaccctttataggttttgggtcgtgacaacatggtattagagctcaaggttcccgtcggtctcacgagtcatgagcaagtctaatagagtctcgcggatcggtacggagacgtctgtacttatcctcgggaggctacagggctattaggagtacttcccttcttgattccctatcgtgcgatttgattccagtgaggcttatgcctttgtttccttcctactcaatcttatgcgacgcagagcgcttgttgtaaatcgagaatttaagaacttcgatggcactacagacgtggtgcgggatgtttctcccggtatagttgattggactgttacagtcgctctatggaaggatatcgtattatttcggctcggtagcggtacttctgggagccttgaggttaggcacaagttaccatgatgcttatgaatgagtttccgtggtattgatatgatggcaggaaaggcaatcgggcagagaatgttcagattgggttgatatcgttgtccttagggaatgtgcaaaattctacggtgttatgatcttctacaattcgcctttggggcaggatattacgggtcagtaatgaagaagcgacggttagaggtcgcgggatatggtggtttaggatggaaccggtgttcctaatgttgatgactcaggaaagatgatcttcggaaaggtttagagtcagtagcgacttgtgggttcaagtgctatgaagatagattcttatttaaggcaacaattgagaagcaaagtatgaagaaggacatgtgggaagtgtcaggcggtgtttaaaacttctagaaggccaagtacgaggagcaaggacgagtggtcgattaaagggatgagttccgccaaagtgggagagtggcgggtgttgcatatgggcttggtagtaggatgactacgcgccttaaggagagtttggaatgatttgagaatttcaaagattagtgattggggcctacggagctaacttgaagcatgggccattatgcggcagaagatttgatatagcggaaaggagctacttgaaatgaaggagggtgcagcataactttgaattgggaggatattgccgcatacttaattgatgtccacgagacgtaaattgactggtgcagccagagagtgagcttggactcaggatgggttaatgatgtcatagtgattgtatcccgtgcagcagcattttaagatgtagggaagcgatttccacaggtgggttatttctgtcgacgccccctttttccctaaaagaaggcgaaatcgggtttacgacattatggacaaaacaactcttattccttttgggggaatcgggctatggaatttgaagagtcgccacctaataattatagtgcattaggacactttaaagaaaagaagaagattttgcaagaaaaccagagttcgggtaagggcttgagattatcttgaggggaaggtgttaggcaccactcaagatccactagtgtggttcccggccatgcttaattgtgactttaaaagaagtagaaggaaataagtaaggttcgcacatagtagttacaaataagtttaaaaattttggaaaggaaagaaaagggcataaatgatttaaaaagagaaggatcaattggaaggaaacataaatttaagaaaggaaacattttttacaaataaagagaaggggaaagaggtcctaggtttaaatacaatatggatcacatcggtgcaataccccatacactcatcaggagaggggtcgcatatgatattagcgcaccagtcatcatctccatattctacccttcccgtcccgtaaaggttatttaaacgtgtggattggtcacgaattcttattgcgtgctattacccgtcccgtcctataagtcctagagggtatttaggaccactattcctataaggtagggactaggctgaacccttaggtttaaaggtcaaaaatactagacgacatgcataacaaataggacttcaagtaaaggaatcatataaataagcaagcaaaaggctcaaatatccctctatagataggcatataatcagcacgtctcaaacacactgaaggtctaaaaatgagagtttaaaagcaagaatgtcggatataggttttggcagaaagcagaaagtttgatcgaaatttttagaattgtaacaaaaatggcagtaagtatatagcagtttaggaattagtaaggaacactttgaaacacactttgaaaatatagagtaaaggtattaaagatgcaggctcataataagtcgtaaaatagcatgattttggaggtagaaaatatggtagaacagatgcaaggttaatcaaaatttcagaagtgtaactaaaaaagagctgtaagtatataggaattagtattgaaacatacttttaaaaattacggtagagatattaaagacacagtattctgataagtttttcaaaaaatagaagcacgattttgggcagggaaggtgacccagtagaaaacatagagaacagatgtgattatctcaaaatagggcagaagtttagtagaaaaatagagaaaaactttcaaagaggcagaattcagaaagttaaagaggctgagtagtctgaaattggtaaaagcatgattaattgattttattaagcctaaggctcgcctaggcgtcgtatacattgcctgattataaaaaggaagtgaacatgcatatttgatttccagtttttaaaagaaactgttaactagacttgtattattagatagaacataccaacgaggcgtttgacaattgcaatttagataaaataaaatcctaagtacatgatatctaattcacataaaggtcttacaacatggtatctaaatgccaatgagaatgctccagttattgtaacagttattaccttattattaatagttacgaaatgagtataataacaggctggagtaaagagcctaaaatacgatttcaaattgtgtgagatgcaagtcctatggaggatgtctattgcacaaataagtagtaaagccctacaagcatgttttctacccataacctttaaattaagcatgcatatccctcccaattttactataaccccaatcattcattacatattattgcaacccaacataattaaattacagaaatggaaagtaaaaataaaaagttattctatagggagccttcaaccaagcccaaatctccaacctcacttctttcgagtttcacagccttttactaaggtttagggtgcgacaaagctccctaagggcccatagggcccttggacaataccaggcacccaaactaattaacattgaacaagtgcaagtgtggaattaccagccttgtgcatcaaagttcaatgggcactcagaggtacccaaagcaatgcttacacgaagggggtagaacctaatctctaagagtagtgagagtgtgatagagttttaaagaagttgagttaaaacagttgaaagatgatccatatagaaccagttttgaaagaaaacaacagaagagtgataaagctctttaaagcaattgagtttaaaaacagccaaagaatgatccatatagaacaacagaagagtgtggttgtaagacaatatcagactagagtatcacacctagttcagggaagacaaacacaaacaggggaaagggaatggggacaagtaactcatatgtaggaacacaatcacacatacacaaacctcaaaagaaagaatttcagaatttagtcaatcaaccaggtttcagccaaaaaggggtcaggattacatgcttgccatatactagactaagtgtcacgacccaatcccggtcgtgatggcgcctggccgcaaggctaggcaagcctgaccaaacaactttccaaagagcggcaattcagcccaaagagatacaatttaaggaaaatagcaaatctagagataaacttccaatcaggatatggcaatacgaataaaacaacagctgaaccaaacaatactcccaatacctggggtcacgagtatagagcctctaacaataccgaatacaagttcgaaaggtaagatacatgtatatgaataacaagaaataactagtaagatcagagtaatcggtcctgcggacgctggcatctacctcaatactctggcaactgaataagcaacagcagcacctgctaaacctttggagcacctgaatctgcacacaaggtgcagggagtatggggtgagtctaccaactcagcgagtaaggagcatatataatacccgaaggtgagaaatccacagaataacacaaagtaaagctaactagcaattctatacagcacaacatcagggatatacatataactcaacggaaagtaaatgcatgtatgcaatgcacatgaccactgtggaacgtgcagcccgatccatttgggtacccgcgctcactgtggggggttcagactccggaggggctcctacagtccaagcgccatatcatacagtgccaatagttaccactgttttcattataatatacggtgccaatagttaccaccgtttccattataatatacggtggcaatagttaccaccgtttccattataatatacagtgccaatagttaccaccgtttccattataatatacggtgccaatagttaccaccgtttccaagaaaatagtataccgtccaaaaaatagtgagataatgatcgtcagcccaaaatatcatttaagaatcatttgagttttcaaaacatagaaatatggctgagtttgcaaacatagtgttaaaaaccctggactgaattcaaataatatgcaaatcatgctaactctgaaatatcaatccctgaaggattctacaaatcggcacaaggccccaaacatggcatcaagcccagatatcatcaatatagtatgcgaagcaatcgccattatagtataatttatctctcggattgaaccgaatcacaatttccaacatatatgaccccgcactagccatggagtgcgtgtctcgcctcatatagcatcacaatgtgatataccggggtttcaaaccctcaggtcatcatctacacccattactcacctcaagccggtcgtagactagctcgcaacgccctttcctctcaaatcaacctccacgagcgacgaatctggccaaaacaacaacaaatacattataataggctaaggggataatacccaatctaaaagactcgaaaaatattgacattcgtgaaaatagcaaaacccgagcccggacccacttctcgaaatcaaaaaaattttacatcaaaatgatcctcgtctcgccacaagtctatacatataaaattcatcaaaatcggagtccaattgctccttcaaatccccaattttcattcaaaattccaagccctagttcttcccctttttgatttgattccagaaatttagaggttaaaataacgtttaattgatgtttctaggccaagggacttacctccactcaaatctcttcgaaaccctcttcaatttgcacccaaaagctctcaaagatgtccaaaaatggtggaaataagaccttgctcgcggatgaaatgttttgaacttaactgctctgcccaggtacctatctctacgcgaacgcgaggccacatcgcgttcgcgatggccaaaattccaccctgccaaaactgcccttcgcgaacgcggctcaatcacgcgaacacgaaggccctgggtcctacacctacgcgaacgcgagctacatatgcgaacgcataggccaaacatcctcgcccccagattccttctacgcgaacgcgttccacgaaccgcgaacgcgatgcctaacttccccaaaccaacgcgaatgtgacccagctatgcgaacgcgaagaccaaattccaggcctcccaaatttcctctacgcgttcgcgactcacccatgcgaacgcgaagagtatttttctgcaacaccaacagctgtgcaacaacattcttccaagtccaaaaatagcccggttaaccctccgaaatcaccccgaggcccccgggacctcaaccaaaagcaccaacatgaccaattacctcattcaaacttgctcgggccataaaaacactaacattaacatcaaaagtcaccaaattcctcaaattcaagcctaagtcaaactagaacttttccaaattcgcattcgatgccgaaccaaaccaaacgaagtccgaatgacctgaaaatttgcacacatatcgaaattcacctaacgaagctacttcaattctcggaattccattctgaacctcggatcaaattctcacataccaaccggatttctccgaaattctaacttcgccaaaatagactaactttcactccgaacctccaaaatcacttccgttttcactcctaagtcataaatcatcctctgaaactagtcgaaccatcggaaatccattccaagccctctaactcacaagtcaacgtccggttgagttttccaacttaagttttccttaaagagactatttatctcatttctatccaaattcaaaccaagacacttcaaactcaccaaacacatataatgggacacggggaagcataaaatggggaaaacgggacggaaacacatgagatgactggtcgggtcgtcacactaaggggtaggaaaacatgcattaaccaaaaatcagtagacatgctgaatttggagaaggttgaaccaaacataagaatatactaattgcaataagagcaacagaaccacaagtaaaatcatagaagaaacagaatgaagtgcagtgtatataaaaacatgttgttttgagagctataaataaaatggagggcataccagttgaggatgcagtaatatagagcaatagtgaacaataatatgcagagtagtgaacagtagtaggtagagagtatgtagagagtatgcagtagtaggcaaacccgagtagatagcaatgtagagagcaatagaacagtaaagcagccaaaaattactcaatcttggctttcagccgactaagtaatcggtagttaataggagtagtgtagagagtgtgctaagagagagtcagaataataaattctgttcgtgtcctatgctaaagagagggtagagtatttatagttttgaaaaccaatagagaatagggtaacaagtatataattatagaaacaataccaattggaatcaatcacaagaccaaattcattttaatcagggagtcataattcgaatggggtacaagttatatcagataaggaaagaatcccttagacgactgaatctaccataataagagtagtaaagcaagtgacatgtaataagggccaaatacataatacctcaaataaagaaaatatatactgaatatttgaaggtatatatttatgcgcataaataaggtaaaaataaattaactctgaaaattagtcaaagaatcacggattagagtaaaatcacaaggaattaattctaagtaaggaaagtatatcacaaataagaaagtaattaaaaattagtgtaaagcttctaaggaaaaacacatacagatcaaggattcgaagagatgcacaaaatcagcaggatattaggtaaacgatgaaccattagacctataaagcacaattggcatgaaaatcaaagaaccctaagcaggaaaatcacgggttcagtagaagactggaaccctagtagaaaacttgaagcatggaactcggagtaaccagaagataacacaaacaaacacataacgcaaacataaccacataatactcaagaaaaatcagaagatatagtgattttgaaaggggttcggaaaccctagctttttgggaaaaagaacaaacgttgctagcttgaacaatcaaagaaaaatcaagtagagggtagtgtaaaacacaacagaataagttaaaaatgctttaaaaagatagagactgagagacttaggcagaaattagggtttcacattaaatcagtaagaggtaaggaacctggctgtgaaactcgttaataatggcgttcatagtaccattggactgaaaaccattggagaaaggcccgaaataagccaagcaaggcttctagtgaccatcttgaattgtggaagtctctggagcctcaaagcttagagaagatcaacgagatacagctccatggcgactggtggtcgagagaagtgaggatggagatggccggagaggcggtggagattattggagaagaaccagaaggttctagaatgaaagaggagatgaagaaaccatgagagagagaccggtctctatgagaaatgaggggtcagggggggtcgttgtatttaatttaggtaaatgaatctgggccgttgatctcatttgatcaacggctcagatcgaattagagccgggtcgggtagttgaattaggtgtgggtcgggttcaaattcgaatatgggtcagggatttgggattgacattgggttcaatttgggctatatttgcaacaaatatggctagcatttgaatatccactgttcccctttttattttatataaatagttaaaatgatttgaaaaataaattgaaaacacagaactaattaataatatataaattttaatctaaaaataccataaaggattttataattataaaatgtggttaattgtaaaataggtcataattgcaatttcatgcaatttagctttaaaaattccaaataaaatatgcaaaaatcctcttaattatattttgttgtaaatatgggatgaaataagttattcaccaaaaaatgatagttttgggaataattttggattttgtactattaaaaatagacaataaattgattctaaaaaaatctttaaaattgaggaaaataccaaaaccttcaggcatgcttatatatgcattcatatgcgattttgaaagtattttgagtataaaaaatacatagggaaaaattgggtatcaacagctgcccctctttacccgaggaggatgaaagagttattgggtaaagataagatggccaattttgaccggaaacgacgattgaagagaacttcgaccgcgctctggtttttgagctgcctacatatccctggttttataggaatcaggccatatgtagttcaggaacaaatgacggaatatgtcgatggaggttcgaaaagacggacacgacggttaagcttgaaaaggcgtttggaatcggacaggttgcggagaaccggagtgggatcgctcctattgaggcggtcgtttgctagccgatgtacctgtaaatgagcaatgtgcacatatattgtgcataatttaaacatgatgcaagttcccgttggaccatgaatgctgtgttcggacggttaggatgccgtcctcagactatgatgtcctgggccatgaagaacagaaaagtaaagattcgcaggccatgaaatggtgttctcgggctatgcagatggtgcctccgaaatatgacgcctttgaataagttggtgattttttagcccatgagaaggtggaaatcattcagccaaatgaatgcaaaaagtggcgatctttcagccggagcgagaatttaaatgcaggtggcaatatttcagccgtgcagaatggagacaatgcttagtctcggaaggcagataagtagccttatgcagtgcagatggagacagagcttagtctcgaaaggcagataagtagccttatgcaggatggaggtagagtttaacctcggaaggcagaaaatagccttatgcaaaatgcagatggagaaaaagcttagtcttgaaaggcagataagtagccttatgcaaaaatgcagatcgagacagagcttagtctcgaaaggcagataagtagccttatgcaggatggaggtagagcttaacctcacaaggtaaaaaatagccttatgcaaaaatgcagatggagacagagcttagtcttgaaaggctgataatatccttatgcaggatggaggtagagcttaacctcggaaggcagaaaatagccttatgcaaaaatgctgatggagacagagcttagtctcgaaaggtagataagtagccttatgcaaaaatgcagatggagacagagcttagtctcgaaaggcagataatagccttatgcaggatggaggtagagcttaacctcggaaggcagtaaatagacttatgcaaaatgcagatggagacagatcttagtctcgaaaggcagataagtagccttatgcaggatgaaggtagagcttaacctcggaaggcagaaatagccttatgcaaaatgcagatgaagacagagcttagtcacgaaaggcagataagtagccttatgcaggatggagacagagcttaacctcggaaggtagaaaatagccttatgcaaaaatgcatatggagacagagcttagtctcgaaatgcagataagtagctaatgcaggatagaggtagagcttaacctcggaaggtagaaaatagccttatgcaaaaatgctgatggagacagagcttagtctcgaaaggtagataagtagccttatgcaatgcaggaatgtaaaggagcgaatggtagtaagttttcttagctgatagatgattgtgatattgtgactgctggggatgttgggtgtagatagtagattcgtgaatgagtgcccgttctgaaagttttcaatcttgaagaggacacgggtgtgaatgtattcgatgatttgtgacctgggtgcctgcatccaaagaaatatcgtgagttctgtaaaggggaaggttagtcgtatcccctggctcttgacgtcacgtatcattggggtaacattgctaaacgatggcgatgcaaatactatttatgcatgatttagtaaatataatgtaagtatatatttgaaaaacaattttattttttgatgaaccaacaactgcaacatggttcgaagacatagcaaccttgcttgtcttggaattttgagggtcctcctcaaaattctgccccagtttactgggctggcgctgctgacggctgtgctgaatgatcgaaaatggattgattccagaattttgaggaccttcctcaaaattctgccccagtttactgggttgatgccgatgaggagactgacaaactgacttcggaattttgaggttcctcctcaaaatttttccccagttccaatatcgggggaaaatggaatttttattaaaatgtgaccgaactcatagggctgcctacgtatcccctcttaatagggaatcaggtcaggcgtagttcaaattacatcataaagaacatgcgatcaaaaatagtatcgtttcactgcgttcgagttgataagcttcggccagacttctccgtccatttctgcgagaataagggctcctccagttagaaaccggtgaaccatgtatggaccctaccagttgggagagaatttccctttggcttcatcttgatagggaaatattttcttcaacaccagttgccctggtgtaaacttccttggtttgactctcttgttgaaggctctggacattctgttctgatataactgaccgtggcacattgcatttattctctttccatctataagggctaacttctcatagcgaccctttacccattctacgtcgtctagctctgcctcttgtatgatcctcaaggagggaatttctacctctgcgggaatgaccgcctctgtaccataaaccagcatatagggagttgccccagtcgatgtgcggactgtggtatgataacccaataaagagaacgacaacttttcatgccattgtttgtgcctttcgatcatctttctcagtatcttcttgatgttcttattggctgcttctacagctccgttcatctgaggtctataagctgtagatttcctgtgctttatcttgaaagtttcacacattgctttcatcaagtcgctgttgagattggaaccgttgtcagtgatgattgattttggaattccgaatagacaaacaatacgatcgcgaaggaaatctgctacaactttcttggtcactgctttatatgatgcttcttcaacccatttggcaaagtaatcgattgccactaagatgagcatgtgcccgtttgatgctgcgggctcgattggtccaataacatccattccccaggcggcaaacgaccatggtgagcttgttgcagtaagctcgtttggaggtacttttatcatatctgcatgtatctgacaacgatgacactttctaacatactggatgcagtccgtttccatagtcatccaaaaatatccttctcggagtatcttttttgctaaaacaaaaccattcatgtgcggtccgcagttccctgcgtgtacttcatctaacagtttggtcgcctctcttgcatcgacacaccttagcaatcccaaatcgggagtcctcctgtacaggattcctccgctgtgaaagaaattatttgataacctccgaagtgtgcatttctgagtagcattggcaagctcttgatattctcctattgtcaagtgttctttgatgtcatggaaccaaggtttcccatcggcttcttcctcaacatgagcacaataagttggttggtcatagatcttgacctggatgggatcaataaaattcgtatctggatgttggatcatggatgacaaggtggctagtgcatcagcgaactcattctgtattctaggaacatgctggaattccatcttcctgaatctcttcctcaattcctgtatgtgatgtagataagggagtatcttaggattcttggttgcccattcttctcagacctgatgtatgagtaggtccgagtctcagatcactagcacctcctgaatgtttatatcgatggccagttcaagccctagaatgcaagcttcatactcggccatgtttttggtgcacgtgaatctgagcttggttgataccgagtaatgctgaccggtttctgataccaagactgctcctataccaactcctttgaaatttacggctccgtcgaaaaacatcctccaaccatcataggattctgcaatgtcttcccctttgaaagctacctcttcatcaggaaaatacttctttagaggttcgtattctcctcccataggattttcgacgagatgatctgccagagcttgtcctttgactgccttatgagtgacgtaaacaatgtcgaattttcttagcaggatttgccatttggcgagcttaccaataggcatgggcttctgaaagatatattttaatggatccatccttgatataagataggtggtgtaagcacaaaaatagtgcctcaatttctgggccacccaggtcgaagcgcaacaagtgctttctaataaggaataccgagcctcgtacgaggtcaacttcttgctgaggtgatagatggcttgttcctttcttccggtttcatcatgttgtcctaaaacacaatcgaatgccccatccaaaaccgcgagataaagcagaaggggtcttcccggttcaggcggaaccaaggctggcggtgtagataagtattccttgattctatcaaaagccttttgatagtcgtcagtccatttagtggcagcatccttctttagcatcttgaatataggttcacaaatgacagtggactgggctatgaattggctgatatagttgagtcatcccagaaaactcatcacatccttcttgttctttggcggtggcaactcttgaatggacttgacctttgacggatccaattctattcctcggtgactcacaatgaaacccaataactttctggcaggaaccccgaacgcacacttggcagaattcaatttcaaattgtaccttctcaatctattgaagaactttctcaagtcttccatatgatctgtagctttccttgacttgatgatgaaatcatccacatacacattgatttctttatgtttcatgtcatgaaagatagtggtcatggccctcatgtaggtagcaccagcattctttagtccaaacggcatcattctgtaacactacatcccccatggcgtgatgaacgccgttttctctgcatgttctttatccatccatgtctgatggtatccagcaaaacaatcgacaaatgactgcagctcatgcttggcgcaattgtcaatcaagatgtgtatatttggcaagggaaagtcgtctttgagactggcccagttgagatcccgatagtcgacacagactctaaccttcccatccttcttcggtaccggtacgatgttggctaacaatgtcggatattctaccactctgagaaccctggcttttttgccggtattggctaaccatgtcggatattctaccactctgagaaacctggctttgacttgcttggtaacctcttctttgattttcaaactcatgtctggcttgaattttctgagcttttgttttactggcgggcatgttggatctgttggcaacctgtgagcgacgatggatgtgctgagactagtcatatcgtcataagaccaagcaaagatgtcttcataccctcttaagaactctgtgtactctttcttttctgatgacgacaaatatacgctgatgcgtgtttccttgacattcttggtgtcacccaaattaacgacctctgtttcgtccaaattagacttaggcctattctcaaagttctcaacttctctgacaacctcttctagtatatcatcctcttctgaatctatatctgtttgttgcattgcctcgttgcaagtcacagtcgttggttcatcatcaagatatgtaatagtaatgctgtgtaaagtaaagtaaatgatagagaaaagtaatgagagcgagatatataacaaactttggaaaatgctttgattaaattcataattgttcgaaacatcggagctcttttcaaaagtaaagataatgcggaaaggaaaaatcagctagtaaaataaagatgcgatgcataatgctcgtttagccttgctaccccgaaactcttcgggcactggtggtcgtgaccgaccaattggtgaggcattcccctcggttcgcaacttgaatggaatggccttcctccccttcctcctcgaagataacacacagtccatatcatcttccagaaacaggttcttcatcgctgccaatgtttcatcttcctctgatccatctataatgttagctagctgaaaggtctgctccagctgaggtcgagggtgctccagtggataatatgggtcacgccatggtggcgaccactcatcaaactcctttcagttgtactcataccctaagccgaaagtagtgccatgtttctttagttttatgggcttggtgataccctggagattcttgccaagtcctttcccgggttcgtacccgctccaattcaagatgctctcaatcttgttatccaacctcttgtctttgtcgacaacattgacctgctcgatgtggtggtacgtttctccgcctattctccttctgcctccgatcatcgggatggtttggcgactgtatatagggttactaccgtcgccgtgaatgatcacctctgggtgattccactcgaactttacagcttggtgcaaggttgataccacagccccagcggcgtggatccagggtcgtcccagcaataaatggtaggatgctggcacgtctatgacttggaagtcaacatcgaactaggtaggtcccatctgtagctacagtctaatctccctaatggtggatctttgagacccatcaaaagctttgacgttgatagcttcgtctttgatctcatgcaaacctttccccaatgttctgagggttatcagtggacaaatgttaaggctggaacctccgtcgaacaggattttggtgatgaaataatcttcgcattgcacggtgatatgcaacgccttgttgtgactaagtccttctggtggtaactcatcttcgtggaaggtaatcttgtggctttccagcacttgtcctaccatattcgccatttcgtctcctattatgttactggtgtcgacgccccctttttcaactaaaggaaaaatatagctaaaatcaggttacgatattatgggcaaaacaactcttactcccattaaggaattgggttatggaattggaagagtcgcaacctaatgattatagtgcattagggcactttttaagatgaaaagaatattttgaaagaaaaaccagagttcgggtaagggcttgagattatctcgaggggaaggtgttaggcacccctcaagatccacaaatgtggttcccggccatgcaaattgtgactttagaaagaggtgaagcatatagacatgtaaggtacaaatgcatattgtccacatattttgaaaagctttaaagaacataaataaagcaaaggaggatttatttttgaaaaagaaagcattttaagaaagcattcaaataaagaatacgtaaagaaaaagaggtcctaggtttgactataatatggatcatttggtgtaatacccgacaatcattatcactcaatggtattaacgcaccgtcatcatctccatattctacccttcccaccccgtaaaggtcatttaaacgcgttggtgtcgtttacttattgcatgctaatacccgtcccaacctgttagtcctggggtattaggacttctaatcctaaaagggtaggaaagagatagggtacatatatggagtatttaaaggtaaaaatactaaggcgacagtcaaaaacacatagcaaataaaggatacacataaacaactaaggctcaaataaccccgtaacaaacagcaagtagtttagcatgacatcaattactggttggtcctttaaagagagggtaagggagcagacatattagtttaacacgtgatagttggatagaaaatctgcttcgagatcctcgggtctgttttttaaagattaacagactttgtaagatgtaatgacccgacccgtcattcaattcatttcagtcccgttacccccgtaatatgctttcccgtgtgttggaatccgtgttgggtgagtttggaatggttcgggtgaaatctagatagaaatgagacacttagtctctttaaggaaggttaaattgaaagagttgacccaaagttgactttcgggttagagggctcggaatggatttccgaccgctcgactagttccgggggatgatttatgacttaggagagaaaacggaatcgaatttggaggtccggtgtgaaagttatctaagtttgccgaagttggaaatgttggaagaatccggttgataggtgagaatttgatccgagggtcggaatggaattccgacagttgcattagctccgttaggtgatttcgaacttgtatgcaaattttcagataattcggagatgtctaagtcgagtttttgatcgggtttgcattatgaaagtttaagttcattttaatcgaattcattggatttttgatgatttttgatgttaaggtaggcgtttttatgatccgagcaagttcgaatgaggttttagaatgattttgtatttttggttgaggtcccgggggcctcggggtgaaatcggatggttaatcggagcatttttggatttttgacaaaatttggcttctgtcttctggtgtttccgctgaagcggaaaagagaccgcttaagcggtctcgcctaagcggaaaatgagccgctggagcggctgggaccgcagaagcggaaaatgttccgcaacagcggaaccgctgaagcggagaaaaagaccgctgaagcggtcgctgggaactgaaggaaaaccgctggagcggaagaatttccgcaggagcggaaccgctggagcggttatttggccgctgaagcggtctccgagattttgaggggaaaccgctggagcggaattgtttccgcctaagcggagtcgcaggagcggaattatttccgcaggagcggaaatcgctgggatttaatatttccagagtgttaaaacactcattttagaagagagagaagagagctcggccaaggcgataattgggcgattttggagagcaaattgaagagaatcatcaggtatgttatggtaggcttcaattatgtcattgtggtgttaaattacggattaaacactaagaaatcaaggttttaagggttaaaaatggaggttagggcttgaaacccacaagactttaaatgtggatttgaggggtcaaatggaccccgatattgatgaaattggtatgtgtagactcggggtgaaactagggtcattgtgatgtaaaaatttctgaatttcgagacgtgggcctggggctcggtttttgcgaatttcgagaattgtgttgtttttcgagtgtttttgattgggttatgttccattaacatcaggtaatatattgggtgtgattttgggcagattcgacgttcgttggagagaattcgaaaggaaaaggcatttcgggctagcttttcggctatatcgaggtgagtaatggtgataactgttgttctgagggtttgaaaccccggactttcacactgtgatgctatgatgaggtgacttgcacgctgaacatgagcgtggggtagagcaccgttggggattgggacttggtccatcccggttattgatatttctaaataattgataaagatatattatttgatattaaaattgggctgtacgccgcatttggggcctagtgccgaactgatatagtcatggtagattgacattcatgcatttccgccgtgggctctatatgagtagatccggcgtggttatgatattgatatatatccgccgtgggccctatacgggtgaatccggcgtggtctatgatattgttatgtcctccgtggaccctacatgggtagttccggagagacttggatattgatattcgtccgccgtgggccctagatgtgggtagttccggtgagactgggaatgcatagcatacatgcattgcatcattcataattatattattgttgatttagctgtgcagttcgtttgggatgacattatgccatttagcttactttgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttactttgtgcatttactgtgatttcttatcttcagagccttagttatgattattactcactgagttggtagactcacccattactccctgtaccttgtgtgcagatccagggcatactcaggctcagtagatcnnnnnnnnnnnnattatgccatttagcttactttgtgtatttactgtgatttcttatcttcagagccttagttatgattattactcactgagttggtagactcacccattactccctgtaccttgtgtgcagatccagggcatactcaggctcagtagatcttgtagaggacagctagtatcagtcaggagtgttgaggtagctgcacggcgtccgcagccatcaactctctttctttctgcctttatttcagtactccagtgtatttccagttatggagtcgttttgtattgtactttgttttatgtcctagaggctcagacttgtgactccggttcctagggtgtattgtacctatttgttatggtatttccagagatttggtatagtatttgcatctttatgtctcattgagtggcttatgggtattatggtcgggcttgcctagccttgcggccgggcgccatcgcgaccgggattttgggtcgtgacataaaatttggcagagttttagaagaaacgagatagtgcggacatgagagtaaaaatatatagctataactggaaaagcgtatttaaactgcagattggagtaaaaagtatatttagactgcagacagaagataaaacgtttcagaactgcgattgaactattacataaaaacatgaattatagataacaaattttaaactgcaaaaaaggtttaaagaaaagggatgcctgcaagttatagaaaaatctgagtttagaaactggagtggtcgaaatacctcaaaggaaaaacagatgaacaaaattacagctttgaggctttgtgaaaaaaggaacagaggcagacttaggcctatcttttgtttgagaataaagaggtggataaagaaaggttgctggtatttattaacttaatgcactatccttcgaattactgtttttatactattagacgtcctaccatttgcctagcgtttatacatttcctataggcatgatttctaggtgagatgcaaatatgaactctatatggagtaaataatatagaacctacagacttgatgaataaccttatggcctattgatgcaatcctataggcatgttctctatatgggcgtaacaatgacaaagctagacagattgattatattaggactaatgtaaacgtgataactatgaatatgcaacgataacccctataggcatggtttctaatgcatgtgacaataattaaattcccctcccatatatcccttttactatacccccatgtttatattacaaagcttattacaaaaccagacaggaaaggaaaatattaaagaaaagagtacatcaatagtcatcaacggacccgaggaatctagaagcaactttaatttccaacattctgcctttaatccaatccaagctcccaagatccgaggccatttctcatttaaaggtgttacaaagttccaaaggccttaataggggcctaggtattgcttacaccttagttacaagagtgcgagtgtgtaattactagccctaaggcatccaagttcagaggagactcataaggtccctaagcatggcttaccgaaggggagtaggaacttagagtgctaagaataagtgccaagtgagggaaacctatgtaaggagtggtcatacccagcctattgactgaggctggcacaccccggaccccttacaaaggttgcaagtaaagagcaacttgtaaacaagtcagacaaaggcctgggaggcgattaggacaccaccaggcctatgtcgaggcctagacatacaataaaggggaaaagggatgggattcatattgagtataggccattggacctgagtttagactagaaatagcaataggatgccattctcatccaaacaaactcaaaaacaaacagggtaaagggaaaggggatcagatagagcaaatagaagaatacagttgctagaaagtacagagaaccccagcatagagaaaaatactgaaagtaaacattcagggaaagggaaaagggtttcgaccttatttaaacatgcagcctagaagaataggggtgaaaaatatgtcaacttaaacaaaatactgaagtaaagagataaaggaatagggagaggggtttagcatgattgagcataagtaagtactgaatgaaacaagcttaaagcaaaagagaacgaggaatcacatgtttaaactgtagtaatgtaaacacatagctaagaggacattaaagagaattagggacctactagttgcacttgattaacaaagcaaagaagggttctataactagctttggctttcagccagctagcctctaacagagaaagtgagtagcaagtagcaagaagagcagaaagtttttagtgagaagagtagggagaactcgagaattgaatgtgttcgagttgtgtgaagtgagaaaggagagagtctatttatagttgaaaaagaagcaacagtaacgcaaggaaaatattcagaaatcaattagtatcaattaggagaaaggaaccccttcaattaagggatcggatggaaaataaacagcccaagtctaattttggaaagaaaatatagcattggtctcagaatatagggtagatacacataggaaaatttaaaaatcacacggttgcacatgtaaggtaagtaatcacccagaaaatcaaggagtcaagattttaatcgtttgaacttggtcagagaacagggaatcattagagaatcacagttgtaccaaaatcaatcagggtttcggggaaaaggagaagcagcactataaaagattcacaagtctgagcatgcaagaactaggcatagtagaatagcaaaacacacacgagaagataattaggcaaactagggtttcacagagagagatggaaataccctttagaaattagggtttcactacaaatcggagcacaagagattagcatagatgaagacgaacaagagcagaacacaaagaaagcacagaaccgactaagaatgaaaaccctagaaaggtaatcagtgaggcaaaaacatttagggctaaagcagaaaacactcagaatcgtgacgagaaacatataataaaaagaaacaaacaacaaaatcaaagtatcaacagttcatagaaaccctaggtttggaaaagacgaacaatctatgaaaaacacaaataggcgaaggaaaagatgagatacttaagaaaatcttcgaaaacaaacaaaaactcagaggagatcgtaaaataacacagagaatcatgaaaaagaacctcgaatcgacttagggttttcataaaagccacagaaatggagagaaaagcctggacggctcaccggagcttggtaaaggacccaaggtttcaaaggctcaccggagaagaaccagacacgaccgtgaaaccaccattaaaggacctctggtccatttgaactcaaaacaacttccgatctttagacctcaaggtcagggacggtggtagatgagcgagtgtgtgaatatccggccatggaatggccatgaaagccggcgaagaggcctgagagtgattagggttagagagagttttagagagcatttgggagtgaaaggcggagaatagttacaaatgactagggttagggggggtatggtggtttaattatgtaagttttgatccgggccgttgatttatgaattcaacggccaagattagaaataggagccgggcgggttggcttagtgggtttgggtcggagggtccgatgggtttgggtattgaattgggtttcgattgggctgggattaggggttaatttgtggttaaaattgaaaggatgggggctacattttaaataaccaattttcccaaatataatttataaaaaatagcaaatgatttataaaaaatacaataaaattactgagataacaaaataagtttaagaactgattaaaactatcaggaatgattttacaattgaaatacttgttaaattgagaaaataggctaaaattgcaatttaatgcaattttagtttaaaataccgaatggctttgtaaaatcctgtaaaaacttacacaaattatatttttatgtaaatgaaagaataaaataattaacttgctaaaataggaaggtttgataccaaatattaaattttatagtgcaaaataagctgtaaattaattttgaaaatgcctgaaaaatcgtagaaaaataccaaaccttttgtggatgcttatatatgcatttataagctattttgaagatatttgggttataaaatatataaggaaaaattgggtatcaacagctgcccctctttacccgaggaggatgaaagagttgtcgggtaaagataagatggccaattttgaccgggagtgacggttgtacgagaatttcgaccgcgccctggcttctgagctgcctacatatccgtggttttacaggaatcgggtcgtatgtagttcaggagtcgtcggcggaatgcgccgatgacaaattgaaaaacggacgcaacggggcttgatgttttgggggtccgaagatcggatgagctacggagaatcggagccggatcgctcctgccgagacggccgtgccagccggtgtacctgtgagtagaagatgcgtgtatatattgcataatttaaacgtgatgcaagttcccgttggaccatgaaggttgtctttagacgatccagatggcgtcttcagactatgacgtccgggctatgaagagcagaaaagtaaagattcacaggccatgaaatgatgttctcgggctatgcagatggtgcctccgaactatgatgcctttgaataagattggcgatatttcagcccatgaaaaaatggcaatattccagccgaatgaatacagaggtggcgatctttcagccgagtaggaatttaaaatgcagggtggcgatatttcagccaaaacgaaacaaggtggcgatatttcagccaaatgcaaaaataaaagaggcagggcttagcctcagaaggtagagaatagccttatgcaatgtaacaagatggagacagagcttagtctcgaaaggccgcagatagccttatgcaggatggaggcaaagcttagcctcggaaggcagagaatagccttatgcaagaaatgcagatggagacagagcttagtctcggaaggccgcggatagccttatgcaggatggaggtagagcttaacctcggaaggcagagaatagccttatgcaagaaatgcagatggagacagagcttagtctcggaaggccgcggatagccttatgcaatgcaaaaaataagggaggtatagcttaacctcggaaggccgcggatagccttatgcaagaaaagaaaaatggagacagagcttagtctcgaaaggccgcggatagccttatgcaggatggaggtagcgcttagcctcggaaggcagagaatagccttatgcaatgcaaaaataaaggaggtagagcttaacatcggaaggccgcggatagccttatgcaggatggaggcagagcttagcctcggaaggcagcgaatagccttatgcaatacaaaaataaaggaggtagagcttaacctcggaaggccgcggatagccttatgcagtgcgaaaatgtaaaggagaagatagtaatgattttcttagctggtagatgattgcgatatcatgactactggggaatgtcggatatagatagtaaacttcgtgatgtgagtagttgtttgagaatttgttttcgggaagtaattgcgtcatttggcttgcgcctcgggtacctgcatccaaagaaaaatcgtgagttctgcaaaaggggaggttagttcgtatccctcggctcgcggcgtcttgtaccatttgggggtagcgttgctgaacgacagtgattaaaatgattttatgaaaatttgataaatttaatgcaaatgtgatgcaagtgtatatatataagtagagaaaagacagttttgttttatgatgaaccgacaactgcaacgtggttcaagtcacggcaaccttgctggcaccggaattttgagggtcctcctcaaaattctgccccagtttactaggctggcgatgttgacggcggcactgcatgactgaaagctgatcgaccttggaattttgagggtcctcctcaaaattttgccccagtttactgggttgatgccggcgcgagaactgacaaactgacttcggaattttgagggtcctcctcaaaattctgccccagttccaaatgcggggaaaaatggaatttcattagagatgtgaccgaacccatagggcttcctacgtatcccctcttaaacgggaatcaggtcgggtgtagttcaaattacatcataaggaagcataatgactaaatgtagtatctctttactgcatctgagttgattggttttggccagacttctccgtccatttctgcaagaataagggctcctccggttagaacccggtgaaccatgtatgggccttgccagttgggagagaatttccctttggcttcgtcttgatgtgggaatatcttctttaacaccagctgtcctggtgtgaatttccttggtcgaactctcttgttgaaggctctggacattctgttctgatataactgaccgtggcaaactgcgttcattctctttccgtctataagggctaactgttcgtagcggcctttgacccattctgcatcatctagctctgcttcttgtatgattcttaatgatgggatttctacctcaacgggaatgaccgcctctgtaccgtaaaccagcatgtcgggggtcgccccggttgatgtgcgaaccgtagtacgataacctagtagtgcgaaggacgactttgcatgccactgcttgtgcctttcaatcatttttctcagtatcttcttgatgttcttattggctgctttcacagctccattcatctgcggtctataagctgtagagtttctgtgcctgatcttgaaagtttcgcacattgttctcatcaagtcactgttgagattggaaccattgtcggtgatgattgattctggaattccgaaccgacagacaatactatcgcggacaaagtctgccacgactttcttggttactaccttatgtgatgctgcttcaacccatttagtaaagtaatcaattgctactaagatgaacctgtgtccgtttgatgcggcaggctcgattggtccgataacatccattccccaagcggcaaagggccgtggtgagcttgttgtagtgagctcgtttgggggcacctttatcatatcggcgtgtatctgacagcggtggcactttcggacatactggatgcagtccatctccatagtcatccaaaaataacctgctcgaagtatcttctttgccaaaacaaaaccattcatatgcggtctgcaagttcctgaatgcatttcctctaatagcttggttgcttctgttgcgtcgacacacctcaatagtcctaaatcgggagtcctccgccgtgaaagaagttattagacaatctccgaagcgtgcgcttttgggtggagctggcaagctctagataccctccaattgttagatactctttgatgtcatggaaccacggctttccatcagcttcttcctcgacatgagcacaataagccggttgattgtgaattgggacctggatggggtcaatgaaatttgtgtctggatgctggatcatggatgatatggtggctagtgcatctgcgaattcattctatattctcggaacatgttggaattccgtctttctgaacctcttcttcaattcctgtatgtgatgcagatacaggagtatcttggaattcttggtggcccattcttcccggacctggcgtatgagtaggtctgaatctccgatgatcaacaactcctgaatgttcatatcaatggccaatttgagccccaagatgcaggcttcatactcggccatgttgttggtgcatgggaacctgatcttggcggttacctggtagtacttcagcggatccatcctcaatataagataggtagtgtaggcgcaaaaatagtgcctgaatttctgggctacacaagtcaaagcataacaagtgcgttccaacaaggaataccgagcctcgtacggggtaaacttcttgctgaggtagtagatggcttgttcttttcttcccgtctcatcgtgctgtcctaaaacacatccgaacgctccatccaaaactgcgagatagagtaataagggcctcccaggctcaggcggaaccaagactagaggcgtagacaagtattccttgattctgtcaaaagccttttgacattcatcggtccacttagtggcggcatccttcttcagcatcttgaagatcggttcacaaatgacagtagactgagctatgaatcgactgatgtaattaagtcttcctagaaaactcatcacatccttcttgtttctcggaggtggcaactcttgaatagatttgaccttggacggatccaattctattccccggagactcacaatgaaacccaataactttccagcagggaccccgaatgcacacttggcgggattcagtttcaagttatacctccttagtctattgaaaaattttcagaggtcctccatgtgatctgcagcttttctgtacttgatgatgacgtcgtccacatatacctcaatctctttatgtatcatgtcatgaaaaatggtagtcatggccctcatgtaagtagctccagcgtttttcaacccaaacagcatcattctgtagcagtacatcccccatggcgtgataaacgccgttttctctacatcttcctcatccatccatatctgatgatatcccgcaaaccaatcgacgaaggactgcaactcatgcttggcgcagttgtcgatcaagatgtgtatatttgttaaagagaaatcgtctttgggactggcccgattgagatcccggtagtcgacacagactctgactttcccatccttctttggtactggcacaatgttggctaaccaggttggatgttcaaccacttgaagaactctggctttgacctgtttggtgacctcttctttgattttcaaactcatgtctggcttgaactttctgagcttctgttttaccggtggacatgctggatcggttagcaacctgtgggcgatgatggacgtactgagaccagtcatatcgtcgtaagaccatgcgaaaatatcctcatattctcttaagaactctgtgtattctttcttttctgtcggtgataggtgcacactgatgcgcgtttccttgacattatctgcatcccccaaattgacgacctcggtttcatccaagttggacttaggtctattctcaaaattttcaacctcttgtacaacctcttctggtatttcatattcttctgagtctatatccgtttgttgcatagtctcgttgcaagttacagtcgttggttcatcatcaagatacgtaatagtaatgctgtgtaaaagataaagtaaatagcaaagaaagtaataagtagcgagatatttcataaaccggaaaagtggttttgattgaaattcataaatgtttaaacatcggagctcttttggaaagtaaagacattacgaaaattaaaggaaaagtgactaaaacaaatatgcatgatgcttgttcagccttgctacccagaagatctccggggaacagtggtcctgattgaccagttggtgaggcgctcccctcggttcacagcctgaatggaagggccttcctccccttcctcctcgaaaactacacaacaatccatgtcctcctccagaaacaggttcttcattgccgcaagagcctcgtcttcttctgaaccatagagagtgtcggctggttgaaatgtctactccagctgaggtatggggtgctccaatggataataagggccgcgccatggtggcgaccactggttgaactcctcccaggtgtactcatatcccaacccgaaggtggtgccatgtttcttcaactggataggcttagtgatgccctgaagattcttaccgagccctttctctggctcatacccgctccaatttaaaatgctttcaaccttgttgctccaccatttgtccttgtccactgcattgactagttcaatatgatgatatgtttctccgcctatcctccttctacctccgatcaacgggacggtctggcgactgtatataggatggctaccgtcgccgtggatgatcacttcctgatggttccactcaaacttcacggcctggtgcaaagtcgatgccacggccccagcggcgtggatccagggtcgtcctagcaataggttgtaggatgctgggacgtcaatgacttggaaataaacatcaaaccaagtaggccccatttgcaaacacaagataatctccccgagggtggccctctgagatccatcaaaagctttaacgatgatggctccgtcctttctctcatgcaagcctttgcccaatgttctgagagtgaccaacggacaaatgttgaggctagagcctccatcgactaagatcctagtgatgaactgatcttcacattgcacagtgatgtgcagtgccttgttatgaccgagcccttctggtggcagctcgtccttttggaaagtgattttgtgactttccagcacctgccctaccatatttgccatttcccctcctgttatgttactcgtgacgtaagcctcactcaatattttcatcagggcattcttgtgtgcctcagaactttgcagcaatgctaagatagatatttgtgccggagtcttgtttaattgttcagcaaccaagtattctttggcctgtattttcctccagagatcatccggtctagtctcaacagtacgcccagaggcctgcttgctggattctgctaggtgctctggcgtgtataccctgcctgttctagtcatgccctgcgcagcgattgcttcacccgtccgtgcttttcctttcctcctcgcctcggctatgtaatcccaaggtatggcattggtctgaaaaggatttatgtctgtcatggtgaccgcaatgggcaccctttgtggcaatatagtaacttcgactggtgcaggtgctttcggagtcccaaattccacttcaattggtttatgcgcctttgcagaaggtgcttcaaactcgaacagtactgatatgtttaccacgtcgccctcagatggctggatttgcacaacaataggattaagggtgactgccggcttcctgggttcatctccttcagatatcaaaccaattgaccctttggggtcccaatcatcttcaacctcgatcatgtggatgccgctacccttgtgatccggtaggggttgttacgaatattaggagcaggctccttggctacaatgaccttgctatcaattaaggtctgaattttgtcctttaaggagcggcattcttcgatagtatggcccttcatccccgaatggtatgcgcagcttttgtttgggttgatccactaggaagggttttctggagtgatggctgggatgggtgtgatgtaaccggcggctttgagtttttcatataattggtcgatgggttctgcaatagcggtatactgtctaggcggtttgcggtcaaagttgggtcttggtcgtggaatattttggcgggtaggtggtgatgggtagtgtgaaggttgagagtggtatgcttggtatacgggttctggttgggagtatcccggtgaggtgggttgatatgtgggtggtggaggtgattggtaggtaggtggtggattttggtatgtgggtgacggtgcttggtagctcagaggagtttggtaggtgactcgggttggagggtaggattggtattttaagggagagtggttacgctgcgcagccattacggagtttacctctttcctcttggatgtaccaccggactgcaagactttgttggtagcctgtagtgcttcaagtttagtgaccataccgtttttgattccttcttcaattcgttcccccagcttgatgatatccgagaacttttgcccttctatcagcatcagtctttcatagtactgtgggtcctaccaacggaaaaagaacctgttcatttgttcttcttccaaagccggtcggactttggcagcttccgacctccaacgagttgcatactcgtgaaaggtttcagtgggctttttcttcaaattttgaatgtagaatacgtcgggcgcattctcagtattgaacctgaagcggtccatgaaattcgaggtcatgccgacccaattcgcccatttccttgtgtcctggctgaggtaccaagacatggcgtctctcttcagactcctcatgaatagcttcatgcggattttctcatctttcccgactccgaccagcttgtcgcaatacatcctgaggtgaaccctgggatcaccggtgccatcaaacatttcgaacttgggaggtttgtacccatccaggagttcgatatcaggttgaacacagagatcttcgtacttcaatccttccatacctttagtactttcaacaccccgcatgcgactggttaattctttgagttcagcagccatactcctaatgagtgaatccttagcgcttgcttctgacatgtctgggataggctgagtatagtgaggcactgtatccacaaagatatgtgcatcctgattgttgggggtatcctggggatcggggatgagcaacggagcattgatgcggatatgagcatgattgggctatggacccttttgtggaggaacgaggatctgaccattgacatccgcagcagtgagggtaattgacagatttgccaaattcccgacttgatctaattcttcccaaaattacagcagagtttgctccagatgagcagcagtttctttggtgattggagtaccctgagaagttccttcactttccttgttatctgccatctttcccttgtttctgtttttgggaggacttggaggaggaggaggaggacccttgggccttgttgaataagctgatggtgccagagcgtgcgaactaacctttggggaggggaataattaaaaaaggaaaaataaaaggtaagaagttagtgcgggttctgaggaaagaaatattacagtatttaaactcatagttgcaggaataaaaatcgttccctatttgggtgcctcgttgtgcccgaggtaggcctagcgacagatagaatttggagaacttataataccaagtgcctcatttcatttatagaaaatggaacgagtcaaaaacagactgaaataaagagatattgtccttcctcggtgttttgagagccggtaaccctcattcgtactttcgcttccagctccagtaggctaaactctatgtgttccatcttttcatgagctttggtaaccctgtttttccattcattgacctggtcatttaccgggagattccgccacaaagccaccaagagcgagggcaccctaatcattccaaagtcggggactccggacgtcattttctgcaaaagaggaaagagttaggccctaacctccgccggggcttgactatttaaatcaataattagcaataggcatttagttctccaaattaatgcgcataacgtgagggtgtccgtttgggtttcaaagaaacccgatagacgtttggttttggctatcttaatgagtcattatgcggacgacataactgactcggctaagtttgactaaatgatgcatgaacagtttaacagagtaagatttctacttttgaagtgctagacaaggtacccttgagcggacaactcaagagagaaaggcgcggaaccgtcgactacaccgttgatcgactggttttaccgcaaatatgcctttgccaaatttaggggatttataatattggaagagcgcaaccactcattataagcgttgctataggatttgtttggcacgggtggaagatgatgttgaaggatgcaattacaacaaataaatacatgtatttccacgttcatacaataatgattacagtaaatgctcgaatttaaagatagaattgaaataatgtaaagacaataaagcggtaaaacagttaaagaaaagaaaaacatgaacaaacaagttagtaaatggaagaaatgattaaagcaattaataaaggcaataaagaatgcagtaaagtcataggtgcatgtaatggtaaaagccttaaagaaatccccagcagagtcgccatgctgtcgacgccccctttttcaactaaaggaaaaagatagctaaaatcaggtttgtgacattatgggcaaaacaactcttactcccgttaaggaattgggttatggaattggaagagtcgccacctaatgattatagtgcattaggacacttttaaagatgaaaagaatattttgaaagaaaaaccagagttcgggtaagggcttgagattatctcgaggggaaggtgttaggcacccctcaagatccacaaatgtggttcccggccatgcaaattgtgactttagaaggaggtgaagcatatagacatgtaaggtacaaatgcatattgtccacagattttgaaaagctttaaagaacgtaaatgaagcaaagaaggatttatttttgaaaaagaaagcattttaagaaagcatttaaataaagaatacataaagaaaaagaggtcctaggtttgactataatatggatcatttggtgcaatacccggcaatcattctcactcaatggtattaacgcaccgtcgtcatctccatattctacccttcccaccccgtagaggtcatttaaacgtgttggtatcgtttacttattgcatgctaatacccgtcccaacctgttagtcctggggtattaggacttctaatcctaaaaggggggaaagagatagggtacatatatggagtatttaaaggtaaaaatactaaggctacagccaagaacacatagcaaataaaggatacacataaactactaaggctcaaataaccccgtaacaaacagcaagtaatttagcacgacttcaattactggttggtcctttaaagagaggttaagggagcggacagattagtttaacacgtgatagttggatagagaatctgcttcgagaccctcgggtcccttttttaaagattaacggactttttaaaatttggcagagttttagaagaaattagatagtgcggacaggagagtaaaaatatatagctataactggaaaagcgtatttaaactgcagattggagtaaaaagtatatttagactgcagacaaaagataaaacgtttcagaactgcgactgaactattacagaaaaacatgaattctagataacaaattttaaactgcagaaaaggtttaaagaaaagggatgcctgcaagttatagaaaaatctgagtttagaaactggagtggtcgaaataccttaaaggaaaaacagatgaacaaaattacagctttgaggctttgtgaaaaaaaggaacagaggcagacttaggcctatcttttgtttgaaaataaagaggtggataaagaaaggttgctggaaattattaacttaatgcactatccttcgaattactgtttttatactattagacgtcctaccatttgcctagcgtttatacgtttcctatatgcatgctttctaggtgagatgcaaatatgaactctatatggagtaaataatatagaacctacagacttgatgaataaccttatggcctattgatgcaatcatataggcatgttctctatatgggcgtaacaatgacaaagctggacatattgattatattaggactaatgtaaacgtgataactatgaaatatgcaacgagaacccctataggcatggtttctaatgcatgtgacaataattaaattcccctcccatatatcccttttacgatacccccatgtttatattacaaaccttattacaaaaccagacaggaaaggaaaatattaaagaaaagagtacatcaatagtaatcaacggacccgaggaatctagaagcaactttaatttccaacattctgcctttaatccaatccaagctcccaagatccgaggccatttctcatttaaaggtgttacaaagttccaaaggccttaataggggcctaagtattgcttacaccttagttataagagtgcgagtgtggaattactagccctaaggcatccaagttcagaggagactcataaggtccctaagcatggcttaccgaaggggagtaggaacttagagtgctaagaataagtgccaagtgagggaaacctatgtaaggagtggtcatacccagcctattgactgaggctggtacaccccggaccccttacaaaggttgcaagtaaagagcaacttgtaaacaagtcagacaaaggactgggaggcgattaggacaccaccaggcctatgtcgaggctcaggcatacaataaaaggggaaaatggatgggattcatattgagtataggccattggacctgagtttagactagaaatagcaataggatgccattctcatccaaacaaactcaaaaacaaacagggtaaagggaaaggggatcagatagagcaaatagaagaatacagttgcaagaaagtacagagaaccccagcatagagaaaaatactgaaagtaaacattcagggaaaggggaaagggtttcgaccttatttaaacatgcagcctagaagaataggggtgaaaaatatgtcaacttaaacaaaatactgaagtaaacagataaaggaatagggagaggggtttagcatgattgagcataagtaagtactgaatgaaacaagcttaaagcaaaagagaacgaggaatcacatgtttaaactgtagtaatgtaaacacatagctgagaggacagtaaagagaatcagggacctaccagttgcacttgattaacaaagcaaagaagggttctataactagctttggctttcagccagctagcctctaacagagaaagtgagtagcaagtagcaagaagagcagaaagtttttagtgagaagagtagggagaactcgggaattgaatgtgttcgagttgtgtgaagtgagaaaggagagagtctatttatagttgaaagagaagcaacaataacgcaaggaaaatattcagaaatcaattagtatcaattaggagaaaggaacccctacaattaagggatcggatggaaaataaacaacccaagtctaattttggaaagaaaatatagcattggtctcagaatatagggtagatacacatagaaaaatttaaaaatcacacggttgcacatgtaaggtaagtaatcacccaggaaatcaaggagtcaagaatttaatcgtttgaacttggtcagagaacatggaatcattagagaatcacagttgtaccaaaatcaattagggtttcggggaaaagggagaagcagcactataaaagattcacaagtctgagcgtgcaagtactaggcatagtagaatagcaaaacacacacgagaagataattaggcaaactagggttttacagagagagatggaaataccctttagaaattagggtttcactacaaatcggagcacaagagattagcatagatgaagacgaacaagagcagaacacaaagaaagcacagaaccgactaagaatgaaaaccctagaaaggtaatcagtgaggcaaaaacatttacggctaaagtagaaaacactcagaatcgtgacgagaaacatataataacaagaaacaaacaacaaaatcaaagaatcaacagttcgtagaaaccctaggttttgaaaagacgaacaatctatgaaaaacacaaataggcgaaggaaaagataagatacttaagaaaatcttcgaaaacaaacaaaaactcagaggagatcgtaaaataacacagagaatcatgaaaaagaacctcgaatcgacttagggttttcataaaagcctcagaaatggcgagaaaaacctggacggctcaccggagcttggtaaaggacccaaggcttcaaaggctcaccggagaagagccagacacgaccatgaaaccaccattaaaggacctctggtccatttgaactcaaaacaactttcgatctttagaccccaaggtcagggacggtggtatatgagcgagtatgtgaatatccggccataaaatggccatgaaagccggcgaagaggcctgagagtgattagggttagagagagtttcagagagcatttgggagtgtaaggcggcgaatagttacaaatgactagggttaggggggtgtggtggtttaattaggtaagttttgatccgggccgttgatttatgaattcaacggccaagattagaaataggagccgggcgggttggcttagtgggtttgggtcggagggtccgatgggtttgggtattgaattggatttagattgggctgggattaggggttaatttgtggttaaaattgaaaggatgggggctacattttaaataaccaattttcccaaatacaatttataaaaaatagcaaataatttttaaaaaatacaataaaattactgagataacaaaataagtttaagaactgattaaaactatcaggaatgattttacaattgaaatacttgttaaattaagaaaatagactgaaattgcaatttaatgcaattttagtttaaaatacctaatggcttcgtaaaatcctgtaaaaaaattacacaaattatatttttatgtaaatgagagaataaaataatttacttgctaaaataggaaggtttgataccaaatattaaattttataatgcaaaataagatgtaaattaattttgaaaatgcttgaaaaatcgtagaaaaataccaaaccttttgtggatgcttatatatgcattcacaagctattttgaagatatttgggttataaaatatataagggaaaattgggtatcaacaacttggaacaaaagcttcactcaatatcttcgtcaaggcatttttatgtgcctcagagctttgcagaagagcaaggatggaaatctgtgctggtgttttgttcagttgctcaatgactgagtattctttggcttgtatctttctccaaaggtcatcgggaccagtttcaacagaccgcccagaggcttgtttgctagactcagctaaatgttctggagtgtataccctgcctgttctggtcatgccttgtgcagcgatcgcttctccagtatgtgttttccctttccttctaacctcagccatgtaatcacaaggtgtagagtttgacttgaatagggtcacgtctatcatggaaaccggaattggcatcctcggaggtagcaccgcaacttcgaatggtgcaggtgcttttgggatcccgaactcgacctcaattgattttggtgcctttgcgggaggcgcttcgaactcaagtggtacaaacatatttacctcatcgccctcagaaggctggatctgaacaacaatggggttgagggtgactgcgggcttcttaggctcatctccttcagcaatcaatctgattgaccctttggggtcccaatcatcctcaaactcgatcatatggatgcctccacctttgtggtcaggcagagggttgttgcgaacattgggagcgggctcctttactacaatgaccttgttatcaatcagagtctgaatcttgtctttcaacgagtgacactcgttgatagtatggcctttcattccagaatggtatgcgcaagttttgtttgggttgacccactgggagggattttttggagttatggctgggatgagggttacataaccggctgctttgagtttttcatatagttggtcgattggttcggcaatggcggtatactgtctgggaggtcttcggtcgaaatttggtctaggtcgaggaaagttttggcgagtaggcggtgatgggtaatgagaaggttgggagttatatgcttggtacacaggtgcgggctgggaatatcttggtgaggtgggttgatatgtgtgtggtggagatgactggtaggtgggtggtgggatttgataagtgggtgatggtgcttggaaatttggggaaggtttatatgtgggtggagctgagggatatgttttcataggggaattggttctttccgcagccattatggaattcacgtccttttcttggacgtgccaccagactgtaaggccttgttggtgtcctgtaatgcctcgagattagtgatcataccattctttataccttcttcgattctttctcccaacttgatgatgtcggagaatttctgaacctctatcaacatcagcctctcatagtattgcggatcctgagcccgggcaaagaacctgttcatctgctcttcttccagggctggtctaactttggtagcttttgacctccaacgagtagcatactcgcgaaaggtttatgtgggtttcttcttcaaattttgaatatagaacatatccggtgcattctcagtgttgaacctgaatcgttctataaagtcagatgccatactcacccaacttgtccatttctttgcatcctggctgttataccaagataaggcatcgcctttcagactcctcatgaacagcttcaagcagattttctcatcccttccaactcctaccagcttatcacaatacattttgagatggaccctgggatcacctgtaccgtcgaacatctcgaacttgggaggtttgtacccctccgggagttcaacatctagctgaacacaaagatcttcgcagttcagcccctcaacatcttagctaccttcgacaccctgaactcggctagttaacttcttgagctcagcagctaaatttcggatgagggagtctttgtcatctgaatcgggtgcatctgagatgggctgggtatagtgtccacaaagataggagtgttatggtcgtttgtggtattttggggctcaggaatgagcagtggggtgttgttgcatgtgttgcaggcttaggtatgagcaggttgtactggtggctgtggaggtacgaggttccgggtgttggcatcagcagcggcaagagtgattgataggcttgccaggttccgaacttgctctagttcttccggaaattttagcaaagtctgctcaagatgatcagcagtccctttggtgattggagtgttctgagaagtctcctcaagttcctttctagtatttgcatctcccatcttgcctttgttcctgtttctggtaggactcggaggtagaggaggtggagggcccttggatcttgttaagtatgcagatggtgtcagaatgcacgaactaacctttaaggaggggaataaaaataaaagaaaagaaaaacaaaaaggtaaaaagttagtgcggattctgagaaagataatattgcgatatttaaacacattgcacagggtacaagtcgtttcctattttgggtgcctcgttgtgcccgaggtaggcctagcgacaaattgaatttggagaacttataatgataaatgcctcattttattgataaaaacaagacgagtcttaaaacgactgaataataaaagatgtcactaatggccagtggacttattacattatgaaagcagtgaaataaaagatcctaactatttggtcccagaaggaccttccccatattccgtattcttgcctcctttgtgtagctgcaccagtttgcgcagtcccagcagcaaataggatcgggccagatgtccacctgtattaccctcaacattctggcagtcgtcgatcctcttaagaaatttaccttccagctccactaagactcgttccaaataccctagctgatttttggcgactacagccatatccttccactcatagatcagcttctggtgagcttcttgtatctcccgatgctcattttcacattcttgcatccttttgcgcagttgattgtatttaactcgcgcttcagttttctcgtcaataagtttatgaccacggacaaaccctggatgacccaaaccgatgtgatcgtcttctaaccaacctgagtaatgcggcacacaccctgcatatacatgtctagatcgaattattctttccccaaaacaaacttgcaatgccacatgtgttgagcttgacacctgtgtgggctatcatcgtcttgaaagtcagccttgtaatgactcattttgtctaccatcggtataatttgtttcctccctgcttgcctcatagctcggagagggacataagggtaagttcctcttaaaccaatgagtataaggaacggtgcatcccgagaccgaacaatgaattccccggttgggaaccactcataaatccactgtacctgttcttcttttagattctccaacagttctacccatcctctagcatcttctggctgagcgaacatattgggcatgaagttcattcgctttggatggtgaaaagtgatgtggtcatcccaatccctgcgtatgatttcctgtctgtagttgcctttttggaggtgttctataagacaaagctggagtagcaagttacaaccttcgaagtgtttggccccttgctgacatttatctaaggctcgatacatctcggcaatgatcatggacactatgctgaaagtctgcccatcaataccttccattaaggttttggctaccatggctagtctggtgtggatcctagccttcttcatgggaaaaatcatcatgcccaagaagcagaacatgaacacaaaggcccctctatgtatatgccctaaagaggtaagggcgaactcgtctgtgtatgtgcgataggacttgctatggccaaacctatcatataggaagtcaaatggtatgtaggaatccttcaaacaagttaaatccggattcttattgagtcccatcattttgaggaaacccctacccttgcgattctccggcataagtagacccagagtctcccaaggaattccagctagacccctatttcttccagtagaggggtcattttgaggtccccgaagcggaaaaccgaccgatcactgtcccagaataaagtagcagcttcaataattttgttgttagaccggacttccaggagtgaaggaagatttcctgagtacttgcggacaagggtccaattactggcatgaaggtcctcccaccagcttagcagccttgggtggatgttggttactttatcgaatctggggatttcgtgcctcattttctgcaaaacaaagtgttaggcccttaaccccgcaagactcgactatttaaatcaatacttagcaatagaggcatttagttctgcaaataaatgcacataacgtgcaggtgtccgtttgggtttcaaggaaacccgatggacttcggtttaggctatcttaatgagtcattatgcggacaacataactgactcggctaagtttgacaatgatacatgaacagtttaacggaataaggtttctacttttgaagtgctagaccaggtacccttgagcggacaactcaagagggaaaggcgcggaaccatcgactacaccgttgatcgactggttttaccgcaaatatgcctttgccacatttagggggtttataatattggaaaggcgcaaccactcattataagcgttgctataggatttgttttggcacgagtggaatatgatgttgaagaatgcagttacaagaatgaaataaattgcatgtattttcacgttcataaagtaaaagattacaataaatactcaaaaaattacaacggtataataataaggcagtaaagaaagaaattaaaagaaaaggaaaacatgaagagccaagttagtattcatgatgaaataattataaggcaggaaataaaggctattaaggaagcaataaagtcacaaaagcacgtaatggtaaaagccttaaagagatccccaacagagtcgccacgctgtcgatgccccgttttcccctaaaagaaggcgaaatcaggtttacgacattatggaaaaaacaactcttattccctttgggggaatcgggctatggaatttgaagagtcgccacctaatgattatagtgcattaggacactttaaagaaaagaagaagattttgaaagaaaaccagagttcgggtaagggcttgagattatctcgaggggaaggtgttaggcacccctcaagatccactagtatggttcctggtcatgcttaattttgaatttaaaagaagtagaagtaaacaaggttcgcacatagtagttacaaataagtttaaaaattttgaaaaggaaagaaagggcataaatgatttaaaaagagaaggatcaattggaaggaaacataaatttaacaaaggaaacattttttacaaataaagagaaggggaaagaggtcctaggtttaaatacaatatggatcacatcggtacaataccccgcatacagtcctctggagaggggtcgcatgtgatattagcgcaccggtcatcatctccatattctacccttcccgccccgtaaaggttatttaaacgtgtggattggtcacaaattattattgcgtgctattacccttcccgtcctataagtcctagagggtatttatgaccactattcctataaggtagggactaggctgaacccttaggtttaaaggtcaaaaatagtagatgacatgcgtaacaaataggacttcacgtaaaggaatcatataaataagcaggcaaaaggctcaaatatccctccatagataggcatataatcagcacgtctcaaacacactaaaggtctaaaaatgagagtttaaaagcaagaatgtcggagataggtttttgcagaaagtagaaagtttgatccgaatttttagaattgtaacaaaaatggcagtaagtatatagcagtttaggaattagtaaggaacactttgaaatgcactttgaaaatatagagcaaaggtattaaagatgcaggctcataataagtcgtaaattagcatgattttggaggtagaaaatatggtagaacagatgcaaggttaatcaaaattttagaagtgtaactaaaaaagagcagtaagtatataggaattagtattgaaacatacttataaaaattacgatagagatattaaagacacagtattctgataagtttttcagaaaatagtagcacgattttgggcagggaaggtgacccagatagaaaacgtagagaacagatgtgattatctcaaaatagggcagaagtttagtagaaaaatagagaaaaactttcaaagaggcagaattcagaaagttaaagaggctgagtagtctgaaattggtaaaagcatgattaattaattttattaagtctaaggctcgcctaggcatcgtatacattgcctgattataaaatggaagtgaacatgcatatttgatttctagtttttaaaagaaactgttaactagacttgtattattagatagaacatactaacgaggcgtttgacaattgcaatttagataaaataaaatcctaagtacattatatctaatgcacataaaggtcttacaacatgatatctaaatgccattgagaatgctccagttattgtaacagttattaccttcttattaatagttacgaaatgagtataataacaggctgaagtaaagtgcctaaaacactatttctaattatgtgagatgcatgtcctatggaggatgtctatttcacaaataagtagtaaagccctacaagcatgttttctacccataaccttttaactaagcatgcatatccctcccaatttcactataaccccaatcattcattacagattattacaacccaacataattaaattacagaaatggaaagtaaaaataagaagttattctatagggagccttcaaccaggcccaaatctccaacctcacttctttcgagtttcacaaccctttaccaaggtttggggtgcgacaaagctccctaagggcccatagggcccttgtccaatactagacacccaaactaattaacattgaacaagtgcaagtgtggaattaccagccttgtgcatcaaagtttagtgggcactcagaggtacccaaagcaattcttacacgaagggggtagaacctaatctctaagagtagtgagagtgtgatagtgttttaaagaagttgagttaaaatagttgaaagatgatccatatagaaccagttttgaaagaaaacaacagaagagtgataaagctctttaaagcaattgagtttaaaaacagtcaaagaatgatccatatagaacaacagaagagtgtgattgtaagacaatattagactagagtatcacacctagttcagggaagacaaacacaaacaggggaaagggaatggggacaagtaactcatatgtaggaacacaatcacacatacacagacctcaaaagaaagcatttcagaatttagtcaatcaaccaggtttcagccaaaaaggggtcaggattacatgctggtcatatactagactaaagggtaggaaaacatgcattaaccaaaaatcagtagacatgctgaatttggagaagggtgaaccaaacataagaatatactacttgcaataagataaagagaaccacaagtaaaagcatagaagaaacagaatgaagtgcagtatatataacaacatgttgttttgagagctataaatcaaatggagggcataccagttgaggatacagtaatatgaagcaatagtaaacaataatatgcagagtagtgagcagcagtaggcagagagtatgaagagagtatgcagtagtaggcagacccgagtagatagctatgtagagagcaatagaacagtgaagtagccaaaaattactcaatcgtggctttcagccgactgagtaatcagtagttaataggggtagtgtagagagtatgctaagagagagtcagaataatgaattctattcatgtcctatgctaaagagagggtagagtatttatagttttggaaaccaatagagaatagggtaacaagtacataattatagaaacaataccaattggaatcaatcacaggaccaaattcatttcaagcagggagtcatgattcgaatggggtacaagttatatcacataaggaaagaatcccttagacgactgaatctaccataataagagtagtaaagcaagtaacatgtaataagggccaaatacataatacctcaaataaagaaaatatatactgaatatttgaaggtatatatttatgcgcataaataagtaaaataaattaactctgaaaattagtcaaagaatcacggatgagactaaaatcacaaggaattaattctaagtaaggaaagcatatcacaaataaggaagtaattcaaactcagtgtaaaacttctacggaaaaacacatacagatcaaggattcgaagagatgcacaaaattagcaggatattaggtaaacgatgaagcattagacctataaagcacaataggcatgaaaatcaaagaaccctaagtaggaaaatcacgggttcagtagaagactggaaccctagtagaaaacaagaagcatggaactcggagtaaccagaagataacacaaacaaacacataatgcaaacataaccacataataatcaaggaaaatcagaagatatagtgattttgcaaggggtttggaaaccctagctttttgggaaaaagaacaaacgttgctagcttgaacaatagaagaaaaatcaagtagagggtagtgtaaaacacaacagaataagttaaaaatgctttaaaaagatagagattgagagacttaggtagaaattagggtttcgaattaaattagtaagaggtaaggaacctagctatgatactcgttaataatggcgttcatagtaccattggactgaaaaccatcggagaaaggccggaaataagccaagcaaggcttccagtgaccatcttgcatggtgaaaatctctggagcctcaaagcttagagaaggtcaacgagacacagctccatggcgactggtggtcgagagaagtgaggatggagatggccggagaggcggtggggattatcgaagaagaaccagaaggttctggagagaaggaggagacgaagagaccaagagagagaccggtctctaagagaaatgaggggtcaaggggtggggggtcattggatttaatttaggtaaatgaatctgggccgttgatctcatttgatcaacgtctcagatcgaattagtgccgggtcgggtagttgaattaggtgtgggtcgggttcaaattggaatatgggtcagggatttgggattgaaattgggttcaatttggactatatttgcaacaaatatggctagcattgaatagccacttttctcctttttattttataaaaatagttaaaatgatttgaaaaataaattaaaaacacagaactaattaataatatataaattttaatctaaaaataccagaaaggattttaattataaaatatggttcattgtaaaataggtcataattacaatttcatgcaatttagcattagaaatgccaaataaaatatccaaaaatcctcttaattatattttattgtaaatatgggatgaaataagttattcaccaaagaatgatagttttgggaataattttggattttgtactgttaaaaatagacaataaattgattctaaaaaaattaaaaattgaggaaaaataccaaaacctccaggcatgcttatatatgcatacatatgctattttgaaagtattttgagtatataaaatacatagggaaaaattgggtatcaacaatttcctgtgagcaggttagcggtcacgtggttggcgaagcttctgcaaagaatttttattggttgttcaacaaagagattggtcgcgcaaatgtggttgatgattcagagttaaaaaaagggtttctaccgaatgattttgagaattttggcggttgattgtgcaaggttatgtcaacaagagatgaagaattctagtgaactccaaaattgtggaatgatggcatcaagctaagtgggagagtcccatctcttatgattgggttgcatgattaactagtggcgtgatttctggttaatagcatattgatgggttatcccagctatgagaaacgaccataagtggtaatctgagcaaatgaattgtcgaatgaataatatggttggccttcttggctcatgttcagacttgaggaaggattcatgatttatgccttgtttagatgcagtcttcagaggaagtgattccaccgggtgattcgtcgagagggtatccatgttttataactagtgaagttggttacaattgagaccaagtcagagcgggtggctctcaataacggtcctagtggattcaaggggtaaagtgtggtgcctaatgattttgagcctatagggtagttgagaatcaagctggaaagcagcttatgaagaaaggcacataatgttctgtggcgttttggcttgcggtgtagcatctgagagatattaaatggttcatgggatttgagacagcatggtctcgtgattcaaggtcactcgggatgagtgtagatggagtatgttatgtgttgaatggagaagtattatttccaaggcaattaagggtaaactggaaggaggtaggtttattagccatagttgaattggcatattggtgtcagtgatcagttccttcagcgtgagcaagttatgcaagtgatttgtggcggtacgtgtgaggcttgtcggccgccgtaattgattttgttcagaagcattcttctgttatggcctgtcatgtgtaggcgaatcccggaaggggctatggtgacttagaccactatttagagatttgcatattcgacggttatgagaattcgcctatatgttgctatagttctcctgaagtgagttaaaatgaaaagttttatatgatgaagtgttagtctatgggcggttctagagttgtgatggaaatcatgtctatcgtatatcaacacgtgaggtgcagagagtggtatggaatttgaagtaaggaccaaggttgcattttggtaaatgactgtgatgtcacgagctcggatgagcaggaaaggagtttcagtgttttgagtaagctggtattgtcgtcagtatcacctgagatcggtgttttgtgaggaaggccttgcatcccggttaaggattcttgatcgctttttagcgttagtgcggccggttgtttggatgtgcagacccgttatttatttcggaaggttgtgggatcgtgtccatgagtgtgacgtgtagtcacttgattgattagagatttaaaccaagtatgagaattttggtaatatcatagatttgagaatttatgtctggaggacactctgtttatcgggttatggactgtggaggtttgccccggttgtgatggatgttcttgtgtgttatgagaagagggaagttagcatggacctttgaaaggttattggcctagtcagcacaatcaggatcgacttgaggtcggtggatggatttaaatatggaagtgagccttacgttaggccagttgtgtttatttcagcaatgtgctctttatggaagaatagtcgcggtcttatttcgtggtcaactaattcatgtaaagatatattgcatcgtatgagttgtgagacggcttggtaatttcttatgtattgaggttccgctcagcggtgatgtcatatgagcaggatggcttttgagatttagatcatgtatcgcacctcagttgtgcttgagttttgtagcctataacgctattgtgcactcagagatggtattatacaccttagcgtgtctatgatcgatattcggtattttgttgtaatgagcaatttagctcgatgtttatctccttatatgagttctacatgtggaccgggtggcacgccgccataggtatgttatttagatcgggtggcatgccccatggttatattgtgtgggtcgggtggcacgtcgccatggttatgttgtttggatcgcattgcgcgccgcaacagtatgatgttcagtacagtccccccatatttgcttttatgtgttctatctcatatttttcccagaaatctagttctagctgtgagcccgcatcacatgtatgattcgcgagcagggtaattagatatccttttcagagttaggcttcctttttgtatcgcattctgagtggtagcctattggcacattgtggcatcatatgggacctttgatcatgtcctggatggcttattgcctgagtagttcgtactgggtgaaacaagattattggatttaggatcagtgcaatctgattatatgaagtatattaaagagcaaggatcgttctttggttcgggatgaggtatggatcttgtcaggagtatagacccaatgatttgttaattcatcagttggttatgaatttcggcacgtatcttctatcgtatcggtgttgtaaaagctggagaaagacctatataggtcaagagacgcattgggagcatcagatttgtggaatttcgactattatatttaaagaatgtttttgtgatcctatgagtaaagtgatgtaaagtgtgaattcaacaaagttatgcagtcatgtttgcgtacaacgtgtattgattgttatggtgatcgtatgttgggaacaagcttggcaggaaattccggatgttggaaattgggctttaagccttatctgcttgaataaaagagtgtatcttctgaattatcgagctaatgtgctcaactgggttgtggtagcacgggaaagtgcatgagggttggcacagtgatttcaggctacttcagtgtagttctcagcacgttcgaggacgaacgtatgtttaagtgggagagaatgtaacgacccgaccggtcgttttgagctctagcacggcgttcagtagtcccgagccataagcagcttcgtttcaggtatattgacttgtacgcgtggtcggaattgaatttcggtaagttcagaatggatttggaaggaaaattctcattttgaaagcttaaagttgaagaaatgaactaggattggaaatttgagtaaatgacctcggaatcgggattcgaaggttccagcaggttcgtatgatgatttcagacttgggcgtatgcccggatcgagtattggatgacccgggagcgttttggcgcctactgtggaagttagcattttagaagaaattgcattagtttggcttaaagtgcatttcactgttattgatgcccgtttgggatttcgagattgggagtagctccgtatggtgattctggagttgggagcgcaatcagaagtgaattaggaggttcgtaggtcattttggagccatttggctaaagatagaaatttgaaggtttttgagaagtttgaccgaaagtggactttttgatatcggggtcggaatcctattctgacagctgtagtaggtccgtaatgtcaaatatgacttgtgtgcaaaatttgaggtcaatcggacgtgatttgataggtttaagaatcaaaagtagaagttggaaattctaaagttcataaagcttggattggcggttgattcatgattttagcgttgttttatgtaatttgaggcctcgagcaagtccgtaatgtgttttgggactgattggtgttattggtcggggtcccggggacctcgggtgtgtttcgggttgtgttgcgctcctatttgatgtttcaacgtcgtttctttggacataaaggggtataatattaagaaaatgagctccaaattgagtttttattaaaccattagatctgtatcgtaatttcggagccatagcaaaaagaatcgtcaaatttggacatcgtatgaggaagttatgctcgtttccatgtcgagaaaagtgttggttgctatcataaccgcaaaagcgaaaattttccgcagaagtggaaattgctggaggcagaggggtttctttaaaaatcgaagtttggctcattttcacttcatttcttccatgggagccgattttggagcaactttggagagtcattttcatcaccaagcataaggtaagtgatctctactagttttgagtatatacatcaattatgtatggattttagcatgaaaatgggtagaaaattgagggttagaggaagtcctagaaatattttgttattagattttgaccacgaatttgagcatggaataaggagtaaattatatatttgagttcctaaggtcatgggtaaactttatcttcaaaaaaatttggattccgggcacatgggcccgagggcgttttggtcaacttttcatttcggggttagaaattattataaattgggttgtaaagtattattgagcatatattaatgaaattgtataatcattggctagttttggagcattgtgcgttggttcaagtcttcggaagaatgtagaatgccggttatggatcttcggagtgaggtgagactcctttctaaccttgtaatagggaattgtccccataggtgagttaattcgttatgtgttcctatttgtgggggctacatacgcatgtggtgacgagagtccgtgcgtagctactattatgctattgtccgggtagtttaggacccaagagcatgttatacttgaactatttgtgaacttattgacagcttgacttgcttaaatcacctcgaattagcaaatgaatttctaaaagatttaaactcaattttcttaattattaaagagaattggcctttatttggatatttgctctatgttgatttcttgatggaccgtctgcctgtgtgtttttatttttggaacgggccgaacgcctcggcagattaaatagatgcatctatggtacgggccgtttgacactcggtagtgcacaaatttacatttttgttggagcgggccgtcgacctcggcgtgatttgcgcatgcttatatggctcgcctgaaatatttaaatgttgatattgcctttttcgcctgatataaattgctaagaataaatgacaagtaaatcatgaaaacccattattacttgaaaaaagagctttcatgtttacccgctttgggaagttaaactgctatagaaatccatattttcctcacctttttagtatatttttacttgaccactagcaagtgttaaagtcgacctctcgtctctacttcttcgagattagacgggatacttgctgagtacacgttgttttcgtactcatactacacttgctgtgcatttttattgcacaggttgactagtggctaggtggcatagcagcatgattaacacagagactaggtgagctgcatttcctcgaggcgattccgcagctagtatattctctttcagaggtctatttactttctgtccaactgtattccggacggatgttgtattttatttctcttatcagtagatgcttatgcacttgtgacacagggttctgggatggtttgaagtattgtattaattgcttaacttttaaattttatttaaaagttatattctataaaatttctaaatagtgaaggaaaaatcctgtatttcaaaagtgttaaactgagattttgattaagtaatttggttggcttgcctgacagtagtgtccggcgccaccacgaccctttgtaggttttgagttgtgacaatttcattacttcctcaataatttttggtgaagtccaaaatttatcaattataaggtacacttacaatttaatgatctcgtatcacatgttgtatttacgaataatatatcttctatagtacaagtgtttgcatgaagataagtatgaaattcacttaagaaaatacatgataaaacataggcataaatgaatacatagtggaacatatatttaattaaaacttgaaaaaagagtttttgaagttatgttgaaaaataatatttggaagttgaagttgattgtaacgacctcaccggtcgtattgagtttttgcactttgcttgccagttcatgtgtatgacttgccccgtgtgatgtattatgacttatgtaaatcattggttttggttttcagggtaataagagcgaatttggaagaaacagttctcagttgaagcttgaaatttgaaaggggtacactaagatttgacttgtttgtatatgatcttagattaaaattcttatgatttggttagctccgttagctgatttgggacttagtagcgtgatcaaaatgctttttggaagtccatggaaggtttagggttgaattggcgaaactaagatttcggcgttttccggttgataggtgagatttttatatagaggtcagaatggaattccggacgtttcagtaattttgttgtatcatgtgggatgtgtgtgcaaaattttaggtcattcggacgtggtatggttaggtttttgatcaaaagttgaatttgtaagattttataaacttaggcttgaatctgaggtattttgattgttttgatattgtttgaagtgttttgatgattggaacaagtttgtataaggtgttgggttgtgtttgtgcttttggttgaggttccgggggcctcgaggcgatttcggatggttaacggagagattggaatttttttgcagcagctgatattgctgcttctggtattttcccacctgcggattggggaccgcaggtgcggcgccgcagatgtgggtgatctatcgcagatgcaaaaaagggccatatgatcagagaccgcagaagcagtatggtgaccgcatccttgatgtcacagatgtggaagattggtcgcatatgcgatgtaggctaagtaagtgaattccgcagaagcggacgtgagaccgcaaatgcggtactgcaggtgtgtggtttgaccgcagatgcgggtcctggtgtcctaagtgaaatccatagaagcggaagtgcaaatgcgcttataggatcgcaggtgcgacagagctgggcagaaggtataaaaattccccttcgtgattttcagtcatttgttcaccatttttgtgcgattttggagctccaagctgtgatttcaagaggggatcaagtgtgtccacagaggtaaactacttgagccttataccttgtatttatggtgattatatcattgtttactcatgaacatttgtgggaaattggaggaagagttgggaatttagggcttgaaattggagagtgaatttttagaatttgaatgaccatatgaggtcgaattttggaaaaatttgatatgtatgaactcgtgagaggatgagaattccattgatgttaattgtgtcggatttcgagacgtgggctcaggggccgggtttgagcaatttcaggattttgatgttaaattggatattttcgagagggcttcgctcccttagcatattttaatgactacgtactggttgtggctagatttggaccatccgaaggtcgattcgtgcgggcgagtcatcgcgggctggagtttggatcggatcgaggtgagtaatgattgtaaatgatattctgagggtttgaaaccccggattgcacatcgtagtgctatattgaggtgagacgcccgctcgatgacaagcgtggggtcgtgcactataggggattgtgacttggcccgttccgattgatgattttaccgcgtatttgattggaaatatttcgctatcactattacttgggatgaatgccatatttgggcctagtgccagctatgtgaacccttcggggcttgttattgatattttctaattttttttaacttcttaattgaattcagtcatgttattttccacttttttcaaaactcagtcatgtttacttttctttaacacttgaaatgatatttcaaataatatttttgggctgagcatcatattttactattgcccgcgaggcttatgtgatttttgactgagtaaggccgagggcttgtggtgtaaggatatcttttgggtcgggctgcacgccgcagcagtgatacactgatctgattgtgaggctgagtgcttgagatatgtacgccacgaggtggcttgttgatatatatatatatatatatatatatatatatatatatatatatatatatatatatatatatatatatatatatatatatatatatatatatatatatatatatatatatatatgaggtcaagagcctgtttatgatgccacgatgtggcttgatattgcgcttgggccgtaaggggcccctcccggagtctatacacccctagtgagcgtgggtacccagtgtgatgtgagatatagcccgaggggctggtactattctatgtcatttcccaaggggctggtattgttctgagatattgcacgaggggccgagttgttgacattgtgcttgaggggcgagcctttatgtgtttatctgtcatatttacctatcatttgcctgtttaattgcgtatttatgccgaggggagaaatttctgtgcttacctgtactaattgctttgcattcatttgcataagtgttgaagagtcatttttaaagaagttttaaccgagctaagatgtttaaagagatttcacagcttcgttgcttttcttaaaggattttatattgcttctgtacaacatgttgataagctatacatgatttcttactgctcagtttttatttacctttgttactcactgagtcagagtactcactttactccatgcaccttgtgtgcagatccaggtatttctacatccggtagcgagttttggcgggttggaagaagagtcatcggagtttagcatggtagctgccggcgttcgcaacactgcttttctccccctttattttatgttgtctatattcagtacattcagacttgtcagttgtagttagaccttagtagatactcgtgacttgtgataccccagtatcgtgttgtgtttgggctgtatccacacattataaaatcttttgcttggttcttggttatttattcatacttagactgtttattaatgtttaactattttaaaaattgaattggaaatagttggctggccttgtcttcacgagaggcgccatcgcgacagggtccgggtttaggatcgtgacaagttggtatcagagcctatgttacataggtctcacgagtcatgggcgggtttagtagagtctcgcggatcggtacggatacttctgtatttatcctcgagaggctgcagaacctttaggaaaaaattcacattcttgaattctgatcatgcgtcctttgattcagcttgaaatgtaactctttgaattccttccacgcgttcatgtgcgcgtgatgttccggagaattttggcacatttcaatactaattgcttagattttagcttgttttagatgcaattatctcctttacttatgtaattttagtatttttgcagtacataaggtttaaggacccaagagcatggaaatgaaagcaaaaagtcacaaaaagacaagaaaagagaaaaaaggcatcgcaaaggatgatatgcggtcgcaaaacccatatgcgagctgtataattgacactgagatcacagatcaaagcagagtgctgagcaaaattcaatgttaagaatgcggttcattctgcgaccgcagaacctgttttgggagccacaaagcagaccgcaaaccaactattaaggctgctgaaggaagaaaatgcgatgcaaaatgcggtcgcatttctacaatgcggaccgcaaaacataaatgcagtgaaggcctggaaactagggttacattatgcgatggacttgtcaaaaatgcggactgcatgtctgctttgcgacagaaatgcgatcgtatatctgacctgaaagggcatttttgtccgttttcttagccctctataaatagatttatagtaattttgtgggctcatcttgtctagtttttgagctacattctaagacttaaatattcttcacttttggaagcttttggttcaagaatcatcactttgtaagctttatgacattaaatactctttggcttttgtattttagtatgagtagctaactttaaatactaaggttgtggaccctaaataggtgttatgttaatgggtgtttaacattgaatatacatacatatatatatatatatatatatatatatatatatatatatatatatatatatatatatatatatatatataacggttggttgatatttatttacttctcattctttatttattgttggtggttgcaaacattaacaagttccactaaattcttgctttgcttgggaaagtagttagaatttagtagaagtaaatatcaaagactcaaggctttaaaccttgtttaatagaatcgcttaggaataagtgggttttatttggcatagattgattgttcttaattgcaactcttttacatttgaaaaaattataaagaggaaatactacccaactattgggaaatattgggtagtcatttagacatcatttgcatatcaaaaggaccttccattagaaatatatcatattaacaccgatggcattacacttcattaaagaggacacaaccttggtttctttaatccaattatttacattctcaatattccaactagttgttactttaaaataaactcaactcatactcttgttactattaattcatactcttgttaccgttaactgaataaagttacgactttagtcgagcaacatactattcgagtaacttttcacacctattccctttgggattcgaccccaaccttgttgggttattatatctgacaccgaccgccttacactatttattaaagtgtaatatgagcgtatcagcgcgcatgtgcgctaagtattatatttgcatcgatggctcgtgattccctaatcgaggggagagatgtgacctctgtgtgttgatgttgggccagtctggaatacttgaggccggatttttgcctatagcttgagcaccaaggtgttgattgtgtgagcgcgtatttctggatctatatgtgttgttgtgtccctattaagggaagtgatgaccagatagttacatgacgagtatgatgtgattgcgagatgtattcatatgatttagaagcgatgagaaaggtctgctggaggatagaagagctattaggtgcttgatttccatctagattctaggtataaccccgagttatgggcgtgtaaagtatcttttcatgtttcctagttgagagtgaagtaaatttcatgttgcggtaagagttcagacacaggaagactaagtgactgcctaaagttcatgacggtggaaggtatgcgcaaaggttagttcgaggtgaagcaggcgggttatctcttacggagtgctcggaagttgtgcgatctttatgttgtctgttagaagatctcatttgcaagtgaaatatatgtgtcgtaatttaatttgggtctcttcagagagtgggtttaactgttgggggaatgaatgcgagatttgcagaagatttaaagtaccagatgatctgtgtttcacgagcttaggaaggattgggtttaatctcactatggtattatggcagcaatagagtatatgcgttatgagttattgagagtgttttaatctatggctccgagccaagtgggggagtctgctatttcttagtcgattgcacggttatgtgctatgttggttccaatttgaggcgtactggtgaatcagttatggcctatggagattgagaccgaggatggctcgagtaaaggaaaattcttagcaaaggttataggatgctttacaggtgtgtaagaatcacaggatgccttgagttgttgtgggcaagaatgctcggtgcatagagcaggaagttgcttggttgtattgggatgaggttatattctgcggtgtcggagtgctaatgaggcacgagttgtttggttcatttgaggagactaattgtagtttgagtatagtgggtgactctagagaatatttctaaagcgttcaaggttttacatgggataattggggattttcaagttgtataattggcaagaaactgaggttttgcaatagagggtgtcaagacttgtgtcatttctatatcgtctatgggattctattcatcaacatcaggaaggtgaaggtaacgaatttatattcgcaggaagtctctttagagtagaatatgtggtacttttgtggatatctaagaaagtattcagtggcttatgagccttagtcagtgtggttttatgtttggttatcgggtggtgagttagggttgaggaattgaagtgttatgcaagaggtagtatcagattgaatgtaaatcagaaggaaccagggtggatggtatagcttggtagtggaccggaccggtatggtaagggcatgattaattccttgggtgtgttcagggtaatgagtttctataggtgttttgcggcggtgttcttaggttttgataacttgcgtagtttggtcgtgttagaaggattcagtcctggcaggtctgggttgtgcaaaggggaactcaaagagttcttgaaggttcctacctcggttagagatgtatctgtgggcatgaggatcatgggatgtatagtgattttcttctagataggatcaatgggaagttcttggttggatgggtacatagttgcttgcggctcagaaaaggtacgaagttctcatgttatcctaggatggtatggtatatgcggtatgttgtggaggattgagattgcgtgtgtaaggttacggttcagttctgaaaggaaggtcataaaactcttaggcagtgagcagcttcagataattaaagaaatgagcttcagataactagagaaatgagtttcagataattagggaaatgatcctcagatgattaaggaagtggtattgctaattggggttatttaactagggtatatgtttcagaaaaaggcaatatgattaagttaatggtacttcggtagtattgcgacactttcctgttagatcaactgttgatatttgagcttgcttggtggcacagaggaattttagaatatctcccttggaatgattgggtatttgaggtgtgtgataagtaggattttaacgtgttttatgcccctacttgcctatgctttgagtataatttgctacaaaatagtctcaaaatacttacaggttgtgcttgattgcaggtttgagcaacaaagtgacgaaatataaaagatcggctcaaaacggagtgaaacctgctcaagtatcaaaggccaagttaagtgatggaataagagcctagtgcggaccgcacaaaagtgcacgcggccgcactaggagattcagagagatgcaaataagaactttcaccacgcgaccgcggttggatccatgcggccggcgtccagctgacgcggccgcgctactcatcgacatttggcaaatccaaaccacgcggccgcggtcatcttcacatggtccgcttcagagcttctcgcggtcgcgctacacttttacgcggtccgcactagacatttcaaagagatagaagttgaagtcaaacagccactgcggccgcggtcataattgtgtggcccgcactgaccccgcagggtaattttgtccagttttttctgcccactataaatagaatattttactatttttaggtttagttgtatttacagaacagagttgcgctcgtgaggatcatagttttagcctattttggcattttagcattaatttctctatagattcttgtagtttctctttagttattaattaatatgtttatttcttcttctatttcttctgttttctcttcaattatgtcaagctaagcccattagctagggttgtggctcaaccctagtgtgagtaattgatgggtgttgcgatctaatgataaattgatattgggtgtttgtatttgggttaattttatgctttaattaaggattggtggttgcaaacattgattctagcttagtgggttttgattcttcttgagaaagagagtctataaccccaaaattgacccaacaaggaattgggatggatccatgagaaatggtagtcccaattaacgggttaaaccccgagagagtaatcacccaacttgaaccctagttgcttgatcaaattggcctacccaattggtctcgagagagtcaattggacaaaattactttctgtaccgagaggtgtgagagtgggtataattgtgcaatggttatagcataagccccaaatacatcaatctatccttagtagtttctaccgttaattatccacctaggtgataccatgaccctagtgcctttctctatattaatcacaacctagaatatattcccttagcataatttagtcttaatccttacttcataatagtagttgtcaatacaaagaaaacccaaaaatgttaggagtgcaattaggagcacaaatataattctaggctaaacagacattccaactctatcactagctccatgtggaaaattcgatctcgaaccactattcgggtaaaacctttagtgacccgctcttcctatattcatgaaatgttgagttggcagcgatcagtgtagtatttattcggacggcagaattgggatcaggtatggtgattcgtgtgctatatggagttgaaatcggggagttctcatgttcaggccatgttgtagttgtggttcgcgtgtatcgacactttttagtgactatcaaggtttggagatcgagcagatattttgttgtttggtatgtcagattttgtatgtgatattgggtatagactggttgtctcagcgtcgcatcattctgggagattgcgctagggcggcgatgttgacgggaatgccgcggattgtgtggcgaggttcgacggattccatgctctagtagggtggttttatatttcgaagacccagcgaacggctgggaaggattgtcttccttattttggttcacgtgatggatgtcagtgtagaaacttctaccattaattcagttctggtagtgagggaattttcggatgtgtttcttgtggccgggcatgtcaccgggaaaggttgtttattttagtattgatttgatgtcgggcaccgtatcgtatggcaccgacagagttataggagtagaaggagcagcttcagctttccttgataaggagttcgtagcatgccaatgtggatgtgtgttctaacttgagtcagattggttggctccgagttgtaatgttgagggatgtgttggttcccttgttattgagcttataagtaatctagggagatctatgagttacctttccgtattgcgaggcgttaggatttgttggttattggcacatgcggtgcggtgttattggggtctctcagtaggattcgagcgggtggagtatcggatattgattggcggatagcacatcggttatgtcctttcgggttgtgttgtgttatggattttccttaccgtggttatgatgatttactttggttctagacatcaattgtgcgtggtcatcaatttcgagcacagtgacttgaggtgctttaggtggagcagtgtttggatagggtcgcgcattgcagcgaagttatgtggaagtatgaccttgcgggttggatcagtgcgttctatttctttgatgtgagatgggttctcagccttgtgttgtggtggtactggtgagcttgaggtacaactcttccatttgacttattttcatgatttgagtatgttcggactattgcttattggcacgtagattgcgcaagttgtggcttaggccagtattgaggtaccatatcaccagagtagtgtgttggatttgatgagatcgttgggatctttaatgaatatgaacagattcgatttcagcatgttggaaggataatatcaaggttcggctcagaaatttgctatggtctttgccaaaggagaagtggcttcatgaatggttgatctgagaaatggttaaggcttactgtgtgtttcatttatcaatggtggtatgtgaaagtgttggaatgagacttcagttgataagaggttttctaccggtattcggatgttgtgtgcaactgctatggaaagaatttgttactacatgtgtttgagttgtgtgatatgtcatgtaattacacctgaggttataggtatgggttattccagctagttcgggcctatttggagtataggtgtgagattttttatcttgtggatggtttcagtagtgaaaatgtggttctaaggtttatgggctaggatggattgtgaaattccagttatattgtgttatcagacctatatgagatagggtgacgtggtatcaccctcgggtatgtgcacagtaaggttatttagcgattggttggcctttggaacaactctgggcatgttcgaggatgaacgtatgtttaagtgggggatgatgtaacgacccgatcagttgttttgagctttagcactttgcttacaggttctcgggaatgactttccccgtgtgatgtattatgacttatgtaaataattggttttggtttttagggtaatcagagcgaatttggaagaaatagttctcggttgaagcttgaaatttgagagaggttgaccaagatttgacttgtttgtatacgatctcggatcgaaattcttatgatttggttagctccgctaggtgatttcggacttaggagcgtgatcgaaattgtgacgatctgatccgttgtctctagtatctccgccccgttatccccgttgtatgcttcttcatgtgtcattatatgtgtttgatgagtttgaagtgtttcggatctaatttggatagaaatgagacaaatagtctctttaaggaaagcttaagatgaaaaagtcaaccggatgttgacttgtgagttagagggcttggaacggatttccgatggttcaactagtttcggggatgatttatgagttaggagtgaaaacggaagtgaattcggaggtccggtgtgaaagttagcctagtttgacgaagttagaatttcggagaaatccatttgataggtgagaatttgattcgagggtcggaatggaattccgagagttgcagtagcttcattagatgaattggatatgtgtgcaaaatttgaagtcaatcggacgtgatttgataggtttcggcatcggaatagaagttggaaacttcaaagttcatcaagcttggattggaggttgattcatgattttagcgttgtttgatgtgatttgaggcctcgacaaagtccgtgatatgtttttagacttgtttgtgcttttggttgaggtcccgggggcctcgggtgtgtttcgggtgagtacggacaccccggaacttagaaaagtggaaagggcagcagcggtgggcggaccgcgcaccttctcgcgctgccgcgcaggggaagaaccccccagcgtcactggtcctacttcggaagcttatatctttttatctacaaggaattttaagatgatttaaaaacaaaagttgtagcccatcgtgtttagtgtccagaaaggtatagaaatcgtaatttggacatctgtagaaaaagttatggccaaaatagtgaagcctatcactacagtcaaagtgctatgcggccgcgaccatttttgtgcggcagcactacgggaaatccgaggggtactctataaatacgaggttttgggttttatttgatattttgacctatagagctcggattttgacgatttttcgaaggtttttcaagaaattcatcggggtaagtgattctaactcagatttggttagagtacatgaatataccattgaattcatcattttatttgtgatttgagatggaaaattggaagaactagggcttggaatttgaaatgaaaatttgggatttgagggagcatttgaactacaattttggtaaactttatatgtacggactcgtggcaagacgaggattccgaaaatataattttcgtaatttttcgagaagcggggccggggctcgggttttgctagttttgagattttggctatttctcggttgttttcgattgggtattgtcccatttgcatattgtggtgtattcgctctgtttttgtctagattcgacgcgcgaggaggccgaagtgagaggctaagacgtcgcgagcttgagatttcgccggttcaaggtgagtaatgggtgtatatgattacctgagggttcgaaaccccggtatatcacattgtgatgctattatgaggctagacacgcactccatggttagtgcggggtcgtatgtgttgtgaattgtgattcggaccaatccgagggataaattgtgctatattggcgattgcttcgtattctatattgttgatatctgggcttgaagccatgtttggggccttgtgccgacttgtggtatccttcagggatagatatttctgcatcttcatgacatgcatattatttgaatacagttcgaggttttaaacactattttgcaaactcacccacatttatatattttgaaaacttaaatggcttttaaatgatatttcgggctgatgaacactattttactatttctggactgtatatgatttatggaacggtggtaactattggtaccgtggattatgatgaaaacggtggtaactattgacaccgtggattatgatgaaaacagtggtaactattggcactgtatgatatagagcttgggctgtaggagcccctccggagtatgaacccccacagtgagtgcgggtacccatatggatggcttgggctgcacgccgcagtgttcatgcattgcattgcatctcatgcattattatctgttgctttacatggttatctcttatgctggtgatgcatagaactgttggtttttagctttactttgtgctttgttgtggattttcttctttcgggtttcatatttagttattactcgctgagttggtagactcaccccatactccctgcaccttgtatgcagatccaggtgctccagaggttttagcgtgtgctgttgctgattatcagtttgtcagagtattgaggtagctgcaagcgtccgcaggacccatctctctgatctttttgtcattttccagttattcggacttgtgtattattttcgttcagaattgtatccagtattattagaggctatgtactcgtgaccccttggtcctgagagtatttctggttctgttagatcctaagttgtactgtattgtccctgattgggaggttcattattaaacttgctgttaaagtcttgaattatttcttttagggctgaaatgccattcttggtaattgtttggtcgggcttgcctagccttgcggccaggcgccatcacgaccgggatttgggtcgtgacaagttggtatcagagcctaggttactaggcctcacgagttatgagccggtttagtagagtctcgtggatcggtgcgtagacgtacgtatctatcctcgggaggttgcagaacctttaggaaaacttcacattcttggaatccttatcgtgcgtacttgattcagcttggtatatgactcttgaaattctttccttacatttgtatgcgcccgtgagcgcccagtattatatgtgccttgatggctgatgattccccgatcgaggggcgagtgattatttctatgagttgatgttgggccagtctggaggacttgaggccgaatctcagtctatggcttgaacaccaaggtgctgattgcgcgagctagtgttatgagcttataagttcagtattgtccctaattgtggtaatggcagctggatagcttcatgatgagtatgttggcaccgtgtgatgtgtttgtatgacttggtagtgtcgaagaaggtctgctaggtaatgaacaaaccattaagtgtttgatttccattgcgatcggatgtgttgccccaagttatgggcgcgtgaagaatctttttcagtctcctaaatgggagtgaggtagattgcatgttgcggtataagttcagactcaggaagactaagtgatcgtgtgaggtatatgatggtggatgatatacatattgaaacaagcaggtgggttagcttctgcagattattcagaagtggtataatcattatgtgtatgttagaagatcttatgtgtaattaaaaagtatttcctatatgttatgattcgaataggcagcgcatgttcatgtatcggttttgataaaataatacatgtggtattgagattaatattgttgatatacattgtgatattttgtcaagttgtggacgtgttgttaggatggtttcggtgattctatggcaggtggataggctaaattacaaaggaaactcttccgaaatttttggaaaatttgggacttagtagagattttgtcgcctaaagagtgggcttaacggtcgtgtgaatgaatgcaagaattgcagaagagttagaatctctgatgattcgtgtttccacaagcttatgagagtgtgagcttaatctcaccatgatactgcgatagcaataaagtatatgtattgtgatgtatatggcttcgagctaagttggggaggttgctgttgaagagctggttgtacggttatgcactatattagttccgatttgatgcatgcgggtgaattagttctggttgcagaaagtgagccgagggtggcacaagtgaagcaaaattttgccaaaggttatatggtgcttcgtaggtgtgagaaaataagagaatgtcttgagttgttgataaagaatgcttagtgtaaggagaaggaagttgtttggttgtatcgaaatgagatcacgtcctgtggtgtcagagtgctgataaggcacgagtggttcgattaattaagtcaagtgatttgcagtgtgtataagagtggatgacttttgagaatggttttgatgtgttcaggattctatatgtatcactcaggtgttttaaggttgagtatgtgaccaagtcagtgttttcatcagaacaggtcaagacttgtggtatttttatattgattacgggattctatgcatcagtatttgggaagtaatggcaactaattcaaagttgcaggaagttcttcgggtaaggtactttggaatgcggtatttctaagaacgttcgagaaagtattcagtggcctatgggtcttagtcagtgtggtctggtgttgggtctcgtatagtgagtctgagttgaagaacggtggtgctacagcaagagggaaatcaagtggaaggcagaccagaagaaatttggacagatggagtagcttgataacggaccggattcggcatgttaagggtatgattagatctccttgtgtattcgaggtaatgggttagcacatgtgatttttgcagcaatgctcttgggtgttgacgattctcttagcgtgttgtaattaaaaaggatttagtcacggcggtttagttgtgcagatggaattgggagagttcttgttgattaatacatggttgaagagatgcattttctacagatgtgagatggcatgagatgtataataattttcttctaaatgggatcaatgcaagttctagactagttgagtgcgtcgatgtctgcggcacagaagggggataaaagttctcgtgttatccttggaggttatggtatatgcagtatgttgtcaaggaccgagatgggcgagtgtaaggtttcggttcagttctgaaaggtatggtagatttggctatgtcctaagtaacgagtagcttcaggtaatcaaggaaatggtactgttaattggaagtgatttggcgatagcatatgtctcgaaaaaaggttaatcctacaaatgatacatcaatagtgttacggcattttcttatgggatcgattgctgatatccgagttgtgtgatggcacaagggagttttagaatatcgctcgtggaatagttgggtacttgaggtgtaatctgtatttcacattgtggaaatttgaatcagatacagtgattcatgtgctatgagcagtcggagactaggagttctctggtgcagtctatgcggtgattgtggatcgtgtgtgtgttgtattggtactgttagcggctattgggaattcggaagtcgagtggatttttccttgcttagtatattaaattttggatatgttatggggatgtagagtgattgtctcaatgtcggattattctaaacgattgtgctatgagtcatgttgggaaatgccacaggttgcgtggcggggtgtatcggactatgttctagctggatggttgtgttccagagactagcggtcggctagaaggattgcgttccttaattgggcctttgaggcggatgtcagtatagaggtttctaccattgatacggttctggtattgagggacttttcagatgtgtccttgtggccaggcatgtcgccaggcgagactgtggatttcggtaattatttggtgccgggcaccatatcgtgcggctccgtcatgagtcatagtaatggaagtggaattttgtagcttacaacgctaaatagatatctttatgcattcagttacttacgattgatgttgatatttagttattatgagcaaatttggctcgatgtgcacctccctatgtgaggtagttgtgtggatcgggtggcacgccgccacgagtatgttatctggatcgggttgcgggccgcaacagtgtgatgtcgagaatagctttccatgtgtttctttgtattccgagggaagtccgtattaagaattgctcggcgaatagcgcttcggttgtgtccttccaggactgaatggtgtatattacttgtttcaccgtgagtgtgatgggttgcttggtatcaggcatcgatctgtgcatggctgtctactttgatcatggtaacataaggtgcttcatgtgtaacagtgttgggataggatcacgcgttgtggcaagtccacgtgaagttatgacctctcgaggaggattcaggtactctattcttatgatgtgagatggggtctcagcttggttttgtaaaggtattgatgagcttaaggtataactcttccggttgagtcaattgtcctgatttgggtatgtacaaattgtttattattggcgcatgtattatgcaaattgcggcttagacctgtattgaggtatcatctcgccaggagttgtgtgttagattcgaggtgatcattagggtcaataatgaatacgaacagatttgtttgcggcaggttagaaggataatattgaggttctggcccgaaaacctgttgtgggaatagtcaacatgaaagtgacctcatgaatggttgatttgaaggactgctacagttcattgcgtgttttggctatcattggcagtatacgaaagtgttgggtaagactttagctaaataagaggttttctgttggtaattgagtattgtgggcaactgctatgaatagagactgtcgttccgagtgttgaaagtgttgggtaagactttagctaaataagaggttttctgttggtaattgagtattgtgggcaactgctatgaatagagactgtcgttccgagtgttgaaatgtgtggtatattgtattaattcacctgaggttgcaggtgtggttgttacagctggttcgggttaattctaagtatagatgtgaggttcgaatcttgtgtatgatttcgggtagtgcagtgtggttctacggtttatgggctagatggattgtgaaatttcaactgtgttgtgttatcggtacctatgtgagttagggtgacgtgggatcaccccggtcatatacttggtaaggtcatttggctattgggttacttctagttcaactctgggtacgctcgaggacgagcgtttgtttaagttggggaggatgtgacgacccgatccgtcgtctctagtatctccgtcccgttatccccgttatatgctttttcatgtgtcattatatgtgtttggtgagtttgaagtgtttcggatctaatttggatagaaataagacaaatagtctctttaaggaaagcttaagttgaaaaagtcaaccagatgttgacttgtgagttagagggctcgaaacggatttccgatggttcaactagtttcgggggatgatttatgagttagaagtgaaaacggaagtgaattcggaggtccggtgtgaaagttagcctagtttgacgaagttagaatttcggagaaatccggttgataggtgagaatttgatctgagggtcggaatggaatttcgagagttgcagtagctttgttaggtgaatttggatatgtgtgcaaaatttgaagtcaatcggacgtgatttgataggtttcggcatcggaatagaagttggaaacttcaaagttcatcaagcttggattggaggttgattcatgattttagtgttgtttgatgtgatttgaggcctcgactaagtttgtgatgtgtttttagacttgttggtgcttttggttgaggtcccgggggcctcgggtgtgtttagggtgagtacggacaccccggaacttagaaaagtggaaagggcagcagtggtggccggaccgcgcaccttctcgcgctgccgcgcaggggaagaaccccccagcgtcactggtcctacttcggaagcttatatctttttatctacaaggaattttgagatgatttaaaaacaaaagttgtagcccgtcgtgtttagtgtccagaaaggtatagaaatcgtaatttggacatctgtagaaaaagttatggccaaaatagtgaagcctgtcactgcagtcaaagtgttgtgcggccgcgaccatttttgtgcggccagcacttcccgggcgcggacctcggtcatttttgtgcggtcagcactacgggaaatccgaggggtactctataaatacgaggttttggattttatttgatattttgacctatagagctcggattttggcgatttttcgaaggtttttcaagatattcatcggggtaagtgattctaactcagatttggttagagtacatgaatataccattgaattcatcattttatttgtgatttgagatggaaaattggaagaactagggcttggaatttgaaatgaaaatttgggatttgagggagcatttgaactccaattttggtaaactttatatgtacggactcgtggcaagacgaggattccgaaaatataatttttgtaattttttgagaagcgggcccggggctcggattttgctagtttcgagattttggctatttctcggttgttttcgattgggtattatcccatttgcatattgtggtgtattcgctctatttttgtctagattcgacgcgcgaggaggccgaagtgagaggctaaggcgtcgcgagcttgagatttcgctggttcgaggtgagtaatgggtgtatatgattacctgagggttcgaaaccccggtatatcacattgtgacagtattatgaggctagacacgcactccatggttagtgcggggtcgtatgtgttgtgcattgtgactcggaccaatccgaaggataaattgtactatattggcgattgcttcgcattctatattgttgatatctgggcttgaagccatgtttggggccttgtgccgacttgtagtatccttcagggatagatatttctacatcttcatgacatgcatattatttgaatacagtccaaggttttaaacactattttgcaaactcagccacatttaaatgttttgaaaacttaaatggctttcaaatgatatttcaggctgatgaacactattttactatttctggactgtatatgattcatggaacggtggtaactattggcaccatggattatgataaaaatggtggtaactattggcaccgtggattatgatgaaaacagtggtaactattggcactgtatgatatggcgcttgggctgtaggggcccctccggagtctgaagccccacagtgagcgcgggtacccatatggatggctcggactgcacgccgcagtgttcatgcattgcattgcatctcatgcattattatctgttgctttacatggttatctcttatgctggtgatgcatagaactgttggtttttagctttactttgtactttattgtggatttccttctttcgggtttcatattcagttattactcgctgagttggtagactcaccccatactccctgcaccttgtgtgcagatccaggtgctccagaggttttagcgtgtgctgctgctgattatcagtttgtcagagtattgaggtagctgccagcgtccgcaggacccatctctctgatctttttgtcattttccagttattcggacttgtgtattatttccgttcagaattgtatccagtgttattagaggctctgtactcgtgaccccttggtcctgagagtatttctggttctgttagatcctaaattgtactgtattgtccctgattgggaggttcattattaaacttgttgttaaagtcttgaattgtttcttttagggctgaaatgccattcttggtagttgtttggttcggcttgcctagccttgcggtcgggcgcaatcacgaccgggatttgggtcgtgacagaaatgctttttggaagtctgtggaaggtttaggcttgaattggcgaaattgagatttcggcgttttccggttgataggtgagattttgatatggagggcggaatggaattccagaagtttcagtagttccattgtgtcatgtgggatgtgtgtgcaaaatttcaggtcattcggacgtggtttggttgggttattgatcaaaagcggaatttggaagattttagaaatttaggcttgaatccgaggtgttttgatggatttgatgttgtttgaagtattttgatgattggaacaagtttgtataaggtgttgggttatgtttgtgcttttggttgaggtctcgggtgcctctgggcgattttggatggttaacggagagattgaaattttgttgcaccagatgatattgctgcttctggtatttacgcacatgtggattggggaccgcaggtgtggcgcagcagatgcgagtgatctatcatagaagcgaaaaagggtcagatgagcagagaccgcagaagcggtatggtgaccgcatccgcgatgtcgcagatgccgaagattggtcagatatgcgatgtaggctgggtaagtgaattccgcagaagcgaacgtgagacttggtaaatatattattgataaacgttatttctatattcaattgaatgaaagatcttaggttccaactctaaaaatgataaacctttcaataggaactgtttccttgtagtagaacctatgcaatacgaattaaatttaattggattgggtttcagatatcaagtacatgttgacccaagacttattgcaagttgcaacaataagaattaacaaaacaaaacacaaaatataagagaaattaacaccagcaccatatgcaatagtggtagtaggtgaactttccctttattctcaaaactaaactcacaccagcataagtacatagtctctcaggcctaacattagtcttgacatttaggacatttgctgcaaatcttgtatttacatgagcaaattttacaagctttgccggcgactttgccaacagctttgccaacggctttgccgacgcctttgccgccgttgattcctgcacccatcttcattgctgcaccaaattaggttatgtagagtaatgtattagttataggttaaccaataaaggaggaaatttaaatgtgatagtattaattctcagctcagccgacataaataaatttggatgaacgtgtgttcctcctctaataacataagttttaaatgaaatgatcacacaatggcgggacttggtgctacttcaacttaccgaaaacataagaaggcatggaaatcgagaaatatagtagaaggttaataggtagtcatgcatctcccttttccttaaagtaatataaatcgatgttggtcttatatatttttattttcagatttttatcaaatacccgttggttctttcgtttcgattatcttgttatcttgctggtgttattgcttattactactgttttttcatcttttctcgagctaagcatctattgaaaataaccctttatcttctcaaaataagggtaatatatgcatacactgtatcattgcttgacccaacttatatgattacaatgaatttactattattgttattgatagtacaattggcagaaacaaggtttcggacattcaagtctgtcaccatcctaaatgaaaactaattttaaggccccgttttttcaaaaaaaaaattaaaaatactgtttgttcatagattaatgatctatttttgaaaaaattctgaaattatttttcaagttcccaaaatctagacttgttctcccactcacaaaacttctaattgttttcaaattaaatgcatgtccaaacataatttcaactttcaaaaattatttttcaaaactacttcaaaaattactttttcaagtttcaactaaatctatgtccaaacgctagctaagagtttggcccaaaagaaagaatcatggttgtatgtaatagagttggggttcgggcggttcggattgtatatgaaaatttctatttggatattcagtttttagattaaataaataacaatcaaaatccaatccaaaaaagctcggattggatcagattttttaagttcggtcttggattaattggattagatatttcagatattcgattttgaggctataagtttagatgtttctttttcttaaaaaatgaacatctaaataaagtattcatgttaacttacctaaaaagttactcgttctcactacttcatccaaataaagtattcaactactgaaatcattatcaaaaaaatattaacaaagacattaataagaccgataagaagtaacaatagtaaattacgtccaaataaaaagtattctgacagtaaattagtaattagtactactaaatatatgagataataactaatggatagggtattggaagtattgctattggcatgtggataatgactaaatataaagtataaaaattttgaattttcagatatccaaatatctaaagtgccaaattaaatatccattccgaaatccaaaaaaataataaactaaacccaaaatctaatctataatccaaaccaaaaatttaaaaaatttggatttcagttcgaatttcgagtttacccagactatgcccatccctagtacgtaagaatgcatgtttcggagatataaataataaaattgaagtgtccctgctctagcaatgtagtttaaactaactaatatagtggagtaatagatagaggaagtaaataaaccttgggttattgtagcaggcgcctttgacatctcccttgcatcagcttgtgaggatattactattagcaaaatagccaaagaaacgcatagaaaaaggttagttttggaaaacattttgatgagctatttggagtgaaaagggaagcaatgtttctcccctatttatagaacttaataatgtctcgtgcgactgtcagaacaatttattctggcacacaaagggtagctagcgactgtgggcttcttattgatttcctaggaatttttcaaaaaagaaaaaaataaggtcatcacatggccacttgacaaatagatcaacttggggcgaatttttttagggattttttcctatctataccatataccaaaccttattaccaaaagtgtttataatttggtatttacccgcctagtccatagtttgattacaaaatctgtaccaaaccaaaaataggtagattctaccctaaaaaggcgccaaatttgtaggaatcagatttaatggtgattctatcaccgttaatttcgaaatttaaaacggaagcaaatccattgcagcgtaattctctcattcttcatatatttttcaccattgatagccattaaaaagcttgaaagctttgaattcaaatttggattttcaaaaatcattatttgtttggattgggtgttgttgtaattaatttgaaatatgtttaggagtttatatctcaatttggaggggttttggtgaagattagacttggttttgactgaatttcagattgaaactcgttgaagaagaagacatatttttccagaaattgtagttaaattgtagttaaattgtagaattatagataaattgtagataaattgtagataatttgtagataaattgtagattaggaagactaaatcttctacaagtcttctacaattatgtcgaaaatgccaattatgctacaattgaaatggaaattgggatattaaaattcaatgtattcaatttgtagatatcttgtagataaaatttctacaaataaaatacaaatcagtttaagtattgtataaagctgtattgtttttaaattggcagaattctgtacccgtttctagagcgtccatgtttgataaatattttttttcgaacagtcgcaattttgaaatctatatggaaatgtcgcagacaaagtgatactgtcgtttctctttatttaaactaataaaagaaatggcaccagattcctctgaaaaagagagaattattagagggcatgattactagtatttctttatagagcatgtatcaatgggtggaagtcttacttgcatcttgaaatcgtgagggattttggagttgatggtaatatacccttaatttgaattatggtatataaattgaaatttggtatgcttaaatgtaataaacacaaaccttaaacatgggaggtaataaggttttctatatggtatacataggtaaaaatcccttaaaacaattcgccgccagttaatattccaaattgatactatttgtcaagtggccatattgtaacgaccttgtttttgttttttcttggaaaattcctaggaaacacgtaactgctatcctttgagtacgcactggataatttgctcaattatattagctcgcaaattaaacagaagatataaatcacattaggcacgtccggtgcgacgagctttgacggagaagattgttggtaagagaaatcgatctcagatcttccatgtgggaaaccactcacccgaccaactcagtcaacctcggcgggcgtgacttcaagttaagagggtgtttggctaagcttataagctggtcaaactggcttataagcactttttggcttatctacgcgtttggtaaaattaaaagtgcttataatccaaaaataagccaaaagtcataagttggtctcccccaacttatcaaatttcagcttataagcactttaggtttgaccaaaatatttactattctatccctaaaatacttatttttaaaacaaaactcttcgtatacttagttcttcagctacttattattaatttcaacacttttatccaaacacgtaactgcttattttttaaatcagcttcagcacttaaaagtgctttttaacacctaatgcttatcagctactctaaatcagctaagccaaacgggctctaagtcttttgttaaggctttctgtgaattcaaaataagttgttctgaacgttattaagttctataaataggggggaaacattatttcccttttcacagcaaaaaattgaaactcgaaatagctcatcaaaatgtattccaaaactattctttttctttgcttttctttggctattttgctaatagtaatatcctcacaagctgatgcaagggagatgtctaaggcggctgctccaattacccaaggtttatttacttcttcactctattacttgtagttattttcacttttaacattttgagtctgcaaatggatgttataaatgtttaaatattcgggtaatattttactttgaattttgtgatcataaatatgtcataatatcttatacaaaagtctcattaacaaaataaaatatcgaaatttcggaattaaaatattattaaatgtatttgtggcattctttgttgaggcgtatttaaaagaaaagtaaaacacatgattgaaacgaagggagtaaatgtttacaactttatacaagtattatttaacattttgctgaaagtttaatgggcattttgaaactttctgagacatattcaacatctgaaatattttgttaccttgtgatatcccaacacggcataaatttcttctttttatctttattgaatttggtaattacctcgtataatagtttaaactctgttgctagagcagggacacttcaacttaattatttatatgtcaacattgcggccatgattctttttttggccaaacacgtggatatatatttacttttggatggcgataagacttcaatatccaaaaccttgtttcagccaattgtgtgatcaataacaataacaataaatttagtataattccacaaataagacctgaaaaaattaatatttacgcaaatcttacttttatttttagaaggtaaagacattatttttgatagaatctgaactcaagaaaggatgaaaaagtaatagaaatgagcagtaataccatcaagataacaagataatcgaagcgacagaactagttgcttgtgagaaaaatctgaaaataagcaaatactttgtgaggttttttttactttgtatactgctgttggagcggaagtcaagtgggccaagccaccttagcttagttttagcttaagtcagttttattattgggcccaattgtatagctgataattaatttcatgtacccagcccatttgtttatataagagacttgtacagtgaatcacaaataataagaaagagcaccagatatttctcttcttctacaaaggcgtatcttctgtcattttcaatcttattgtgttgatcatgaactcaacaattaacatggtatcagagcccggaattgattaatccagtaccggagtttactttgtagtaagtttctaattgtttttcttcgattatcaagtcatttcatggtggtaatctgttccatccgacgagatatactacgacggttttggtggtcgtttgtgggcgattatatggttgattttcttcgttctttgattctctttaggtattctatttcgttgaggacttgagagaagtttggtaaattttccccaattttgaaaccctaatttcaatttctatcaaacatctattttttgttgttgttgatatgggttcaattagtgaggaaacccctaatattgttgataattctgttgtcgcaccttcgtcccctttgtatttgctcccttctgattctcccggcactgtattggtcactacgacttttgatggcacggggtatgggagttggtgtcggggaatgctgttaggtttatcgtgcaaaaataagttgggaatgattaatggtactgttactaaaccgagttccaattctgcacttttcgaaccttggactaggtgcaacgacatggttgttgcctggatccttaatagtttggatagagagattagagagactgtgatgtacactgagtctgctgaaaaactttggaaggaaattgagcgtcggtttggccaagccagtgggataaagattttttcaaatccgcaaggagatttcttcaatttctcagggtaattctactgttgcctcttacttcaataggataaagaagttatgggatgaactttctttctccatttcacatcctgagtgcatatgtggttgcaaagaggccttcctgaggttagacgaggagcagaaagttcatcaatttcttatgggactgaacgagtcttattctaccatcaggagaaatatcctgatgatgaaaccgatgttgatagtgtttattctatgttgataaatgatgaaagtcagtctggaattcaacctaatgctccttctttcaattctgattctgtggccttctctgctggggttcaaaagccttataatcagcgggtcaattttgattcttccaagaaaactaatctggtgtgccggtattgcaagaagcctggtcactcagtggacaagtgtttcaagctacatggttatccaacaggttttcagtctaggtttaagaggagtgcagcttttgctcaagtttcagattctcagcccccaacacatcctgagactcttgtttgtgagagcaaacaacttcattctgaaggaggggtttccagtattaccaaagagcagtttgatcagcttttgactcttcttcaacagtccaaagtctcacctggacctcaggaaatttctgctggatctgccaattttgcaggtctgataggtaatcctgactttgtgaattctggcttacttgcttgcaatttttctagggtagagaatagtccttggataatagattcaggagcaactaatcacatgaccccaaactcttcctttttgactaatattaaacgactcactgtgccttatcttgtgactttaccgaatggatataaggtaaaggtaacttgcactggtactctcactttgtctccagatatttctcttttcaatgtccttcttgttcccgcctttcaatataatctcatttctcttgctcagcttatcattcaaataaattgtctagcttatttctcttcatctgtatgtgttttgcagggcccttctctgaagaagccagtggttcttggtagtcttcaggatgggctttatattctcaatcctgccacttttaccagttcttctacttctgctttaagtgcaccctttgtaaataccattactgccaaacatttacatgcaatgaataagagcagtagttctatctcaaatgttgcatcttctgtttctatgcctgatgttgcatctggtgtttttgtgaataatgttgttgtttctacatccactcaggcacatgcattgtcatttgaccattcttggcatttaagacttggacacatgccttttagtaaaatgaagactctcccttttttatctgagaagttacccaaaaagcaatcttttatgtgtcctatctgtcctatggctagacaacaaaggcttcccttccctgaaagtactatacgttccacttcaccgttccagttaattcacatagacctttggggtccttatcatacatctacttacaatgggtttaaatattttatgactattgtagacgatttttctagagccacttggacacatttgttatcatctaaaggaagtgctttcactctgcttcaatcattcattttcatgatacaaacgcagtttaattccactatcaaggtggtaaggtctgacaatgcctttgaactagggtctagtactacagctttagctttcttttccactcatggcatattgcaccaaacttcttctccacatacacctcaacaaaatggtgtagtagaaaggaagcacaaacaccttttagaaactgctagagcacttctttttcagtccaagttgcctctaaagtattggggtgaatgcatcttaactgctacctatttgataaatcgattcccttcttctttattgcgaaacaaaactccttttgaattgctttatggaattgttccttctctgaaccaactaagagcttttggctgcctctgttttgctgctgtacctaaaccatacagggacaagctcaagtccaggtccattccttctgttttccttgggtacacccctggtaagaagagttacaaattattggatttgtccacttacaaaatatttcactctaggtatgtcttgttccatgaaaatgtttttccatactctgatcctacttcatctcatctgttttcccccctgcaccatcatttgattcagttcacatccattattctcctttttcttctcctgttccccctcattctcctcctacctcttctcctcctactttttctcatgatttgtctgcactttctcctatcacatctgatgtccatcattcttcttcctcctctgttcctgttccaccacctgccctcagaaagtcctctagatctcacaatcctcctccttatcttggtgattatgtttgcaattctgtttctagctctaaggttctttccttgtccactgataattgcttgcaagagcctctgttttatcatcaagctgcttctcatccttcttggcaagaagctatgatgcaagagtttcaggccttggaagctaaccacacatgggatattcttcccctacctgctggtaagaaggccattccttgtaagtgggtctacaagatcaaacaaagggctgatgggtcaattgagaggtacaaagcaaggttagtaattaggggtgacaaccaacaagaaggggtggatttcaatgagactttctcccctgtagtcaagttgaccaccgtcaagtgtcttttgtctgtggctactaaaagaaattggaaagtataccagcttgatgtcaataatgcatttctacatggggatttggatgaagaagtttttatgaagatccctccagggttgtctgtttcagcatctacttctataccttcttcctctttggcttgcaaactgaacaagtctctatatggtcttagacaggcctctaggcagtggtatgccaaactctcttctgctcttcaatctaaaggttttcagcctagtttcaatgattactctttgtttagaaaggcttcaggttcaagtctcactttagttgctatctatgttgatgatatcctgttggctggtgatgacatttctgaaatccatgcccttaaacagtttttggatgaccaattcaaaatcaaagatcttggtgagattcattactttcttgggcttgaagttgtcaagcatccccaaggattcttggttagccaacacaaattcactatggatttgctctctgaatttgagtgttcttcagtgactccagtggtggctccattagacccccatgttaagttgtcaggtgatataggagagttactccctgatccatctgtgtatcgaaaattagtagggaaattgaactacttgcagcataccagaccagatctttcttataccgtgcaacatctaagtcagtatatgtctgctcctaggattcctcatttgacagctgcttatcatgtcttgaggtacctggctggttcctctgatttaggtgttcttctttccaactctcctgacttttctttgcacgactattgtgattctgattgggccagttgtgctgatagcaggagatccgtttctggttttgtgttgtttttgggtggatgtcccatttcatggaagtctaaaaagcagcccactcttgccttgtcttctgctgaggcagagtatagggctcttaggcttctggttgctgagatcacttggttagtccggctgttggctgactttgaggtggttgatcttcgtccggttgcagtctattgtgataatcaagcagccatccacatagccaaaaatcccgttttccatgatagaaccaagcatgttgaggtggattgccattttgttcgaaatgccttggctgatggtttgatttctttgcattctatttccacttctgctcagattgctgatgtgtttactaaatccttgcttggcgtgcagcagcaggcttttattcccaagcttggaatggcaagcccttccagcttgcgggggggtgttggagcggaagtcaagtgggccaagccaccttagcttagttttagcttaagtcagttttattattgggcccaattgtatagctgataattaatttcatgtacccagcccatttgtttatataagagacttgtacagtgaatcacaaataataagaaagagcaccagatatttctcttcttctacaaaggcgtatcttctgtcattttcaatcttattgtgttgatcatgaactcaacaattaacaactgcagggtactttgttagataatagcgtaaaaatttaatgaaatacatgtacaaattattactcccaagtatgtgatagtatttaattggatgtaaaaaaaatttaaaaaaattatggttcttaaacaagtatatattaattgtgaggttataaatcatattccattctgtctacttattggatatttggcatttttcttgtgatctataatatttaattttttttagatatcatgcagaaattaactctttttttctaaagttgcctttaaagtaaagagcccgagaatatttattatatttttaatgaacaaattaaaattaatatgagcactttcattattaattaatattaaaaggtaaattcttaatatgtgagaaaacgacaaaaaaaaaaaattcaaaatggaccaaaaggagtatcacttaaaactattacacctgtgacgtgacaatctaaacttaagtaatgagatgatggaagaaacatactagtttctatttttgaaagtatggtgaaaagtacttttcctcaataaatgggttccctctctatttcttaagtgccgctgatttacaatgtaattatgaaacagtttctctggctttatttttcatttttttattttttttaaaagatgctgttacggaaagcacacttaattatctcttaatgaaacattttgttagagaagggacgtatttattctaattactcaatttgttttaaaaacaatgaacctttactattttgggagtcgaacaaagttttgtttgactctgtttttctcaaataatttttaaatatttaattgataactactataactcataatattttttatgtaattttaaaatttgtcagttttatttttaaaaacaaacttaaagaatatatgaattcacataaaaactttgtcaacgaaacactgaaaattattgacataaatttccctttttaggtgaacctatagctaatacatcataacctttttgcagcaatggattcaaacaacattagtgatcaagcgggtggtcggttccgttgtttgatttgcagatgttgtgtcggttaaattttatatatttttcggctatcaaatattatactaagtttttgtatgtgctaaaagtaataatactctaaaagtaagcactgttatgaataatttgtacattggatactacattggatactacattggatgctacattggatgcccatgttgtacattggatactacattggatactacattggatgctacattggatgcccatgttgtgaatatcttaaagattaaatctcttattttatgtccatcatctttactttttatgcctataaaagaccatgtaattgcaatagaaataaacacataattgaagaagaaaatctcttccttctctctatctccatttcttgttcatgttttaataaattgcttttatttccttgttccatattgttactttgagttatattttataacacgttatcagcacgaattgttattttatttggcacttagtaaaaaaaaaaagaagacgaaaaatgcaaggaactgactttgaaggtaaagttattaaaagtgattgttttcttctaagttaaatggtccaatcccggatacattgggcaagcttcagaaactacgtttcatgtatgagctatacatcattttgcctcttttactatgtatttgttttggtcttcttttcttctgttgaatagtttcttaacattttgcattttatctcctcaaatatatttgtggtaagactaattttaccattacaaaagatatatgcacatgcaattatcatataaataaaacactagatgtattggtgatactattgtgtttgtgatgatgtcatatattgtatattgtttaatttattttttgcaatgaaaaatgttaaagaatacatgtaagagattgtgttttttcccttatatttaaccatgtcaggtattattgttcatgaaaaagatctatgctagttctaattaaaattcaaagtgataatattttaaaggctcaagggtgagtctcagttgtattttggcctattattttattggttgagggtaagacggtgggctcatgtcccatcgcaccttgagggtaagacatcaggtttaagtcctagtgcaccatgataataagacgttgggtttgagtcccaatgcatcggattgatgatataatgatgactaaagaaaaataatatattttcatggaaaagaatgaagtttgtcccacttgatttgctccattcttgaagtgaatgtgataacggtgcataataagtctaaatgaagataagtggttgaccgatacatgaccatgccaaagatcaaaataataatagtcatcattatggtaattataaaagggacaacaataatggttctcaaaatctcaaaatatgtcctcgaaaaggtaggctaatgtttaccatcaaattggtaaggaaaaaaagaataaaacacatcgctatgattatactccattcttggaagagaatgtgacttgtgataaacatttttatattctttctaataatattgatttttgtttggtactaaagaagagcacctcctatatccctcatgttaatctttttgtggacattgtttatggtgatgactcttatcttatgactgttttaagtctgaagtttttcttggttaactagtgttttaattgcagaagttctgtcatttttcactttttgtgttgaatagtcaagattttcagacttacaatctcaaatcttgatttggttgtctctaacccctaagtttattaaattacactttggccctattttctattataaataccttccattcttattcattttttcccacaacaaatcaatcttctctctcaaatctcttaccatctaatattctatctatattctatattattctctcaattttgttactatcaagtatcaagattcaactttcaagtatttgggcagttttttttttgagcaacattcaagcttcaaattaaattcgtcaagtatttgggaaatttcttcaagtttcaatatttgtgttagctttttaatttagtttcatatttaaattatggcacctaaaatgcatttggtttgcttaaaaaaggatcaacaactatttgtggaatttctgttgtatacttgtggaattgttgttgtacttctggttctgatcatgttcttctggtatatattatccaactgttagccaaatattatggtatatttgtggaattttccttgtatgagaaatgcaatgaataaatgcaatgaataagacatgcaattcatgattatatgaataccacacaactcacctctaaggaaagtttgagtgaaataaagagaataaatattattgtgtggttacatgaatatgtcattgatcgcgtacatgtgatacgccaaataatattttaccatgccttataaaagttattaaaggcaaaattaaagcaataaataactttgcttatgatgattctgaccatgacaatttattatgatataagtttctccgtgaaggagacatttaccatatgaacaatatgataaaagattttgtagtacaaaaattgttaagagctccaaaaaaactaatttgttactacccggatgaataaaattatttatgacattgatattgtaaagtctcaaaagaaacgttttttcaaatgtataagtcaaagtggttgtcatattgagacaataaatgaaaggaagattgaatatcttcatatttctataatcatatcgggtaattgaatatgaaaagttacccggttttctttctatttgtactacataaatataagcatgatgcttgaatcatatgccacaagtaaactagaggtttgctaaaacaaaaattagttggcataaccggttgaccatcccggttcaattatgatgcgaaaaattaattgagaattccattgacgtatattgaagaatagaagattcttcaagaattctcttgtgctgcttattctcatgatataccagttaaggttgggattgaatcccttgatttctgaaacgaataaaaagtgataaatatatgggcccagtcacctgccatgtggactgtttactattatatgattttaatagatgcatctattctatggtcacatgtgcatttattatcaacatgcagtttagtttttgcaagattacttgctcaattattagagcaccgttccagaatataaattatgatgatttatcttaataatactggtttaaatccaagctggtttagcagaaattgtatgcctccaattatagctaaatcattggttatgagaacaaaacacacaaaaataaaattttgcatgagatgtattatttaatatacagcagcacttgtacgcatctagccaagttatgaaaatttctccctatcacaatgggttcagggtcaggaaccaaataatttctatatagaaatatgaatgtgctatataatttaattatgccaccacaatgcacaaagatgggttcccacggaaggttgggaaatgtgttggtgatcctaacattagggggagaaaatggcagctgaaaaagtaatacgtgaaatgaattattatacatacatatagatcctcgtacaagaaaatatgaacttgaagttaagtgataattcatttacaaattattgccagacacatttgctgacccaaagctaaatgtcatatttcatctgctaatgctcaaaacagaataaagtctaagggggacaaagtctatgccacgcatgaagcgtaacagaccaatcagttccaaagataaaactccttgaagaaggagagggacaaatattcaaaatggtcataataaggaggcaaatgctctagaagagcaccacgacataacacttcataagacctcatgggagaggctgaggtacctgaaataatgagataaagagatctcaataagttatgtctttattaggtaataatggaactgacataaagtgatcgtcgacgatattgtaaatataatgtagcgctcaatactattaatattgacgaggatcttgagctcaaatctgttatgaaatttggacagataaatgattggtcaaaataaaataaaataaaagacgcaatcaagatcgatttcacttgaataaaattggactgatagtcccaactcataaaagtataaagccagtggaggtataaatgtattcttgtgtgtaaaaggccaagtcgatatacataaagacgacttgtattacaagaagattgaaaatatcctggcattgattatatagagacatgttctcttgtggtggatgtagtcatttcaggttttaatctggcaatacataaaaaaaacttgatatgcgtataatggaaatcattgaaggatttaaattgttctgaagcatattatgatttccaagaaatttattaaataaggcttcaataatccttatacggattgacacaatcagggcgcatgtggtataatcgcccgagaaaatacttgttgaaagaagggtacaagaataattcagtttgtccttgtgtctttataaaaggatctggaattaaatttgttataatcgccgtgtatgttgatgattcaaatatcattagaacgggggagcttcataaagcagtagactgtttaaagaaagaatttgaaatgaatgatcttagaaagataaaattttatcttggtctacaaattgagtatatgaaagacgaattttttgtccatcaatcaacatacattgaaaatattttaaagcgattctatatggataaagtacatccattgagtaccctgatggttgtgtaatcactcgatataaataaagattcattccgacctcatgaaaataatgaagaacttcttgatcctgaagtaccatatcttagtgcaattgatgcactaatgtatcttgctaacactacaaggagtgacataaatttttcagttaatgtctgagcaagatatatctctactaatacaaggagacattagaatgaaatcaaacacatattgtgttatctaaaatggactaccgatgtggacttattttatggcaatgattgcaatcccgatcttgttggttatgctgatgcgaaggatcaagaatgtgaattgatgctctcatcagggggtagttaatacgtgttgtactctttttcccttacaaggttttgtcccactgagttttccttgcaaggtttttaacgaggcaaccaaaaggcgtatttctaaacatgtgtactctttttccttcactagaattttttttcccataggattttttcctagtaaggttttaatgaggcacatcatcttacatggacatccaagggggagtgttatgaataatttgtacattggatactacattggatactacattggatgctacattggatgtccatgttgtacattggatactacattggatactacattggatgctacattggatgcccatgttgtgaatatcttaaaaattaaatctcctattttatgtccatcatctttactttttatgcctataaaaggccatgtaattgcaatagaaataaacacataattgaagaagaaaatctcttccttctctctatctccatttcttgttcatgttttaataaattgcttttatttccttgttccatattgttactttgagttatattttataacaagcacaacattgtggtacttataattattagtttgtgttttgttttacatgtcttgtccggctgtctttcaactttgtggtactgtaattttaattcttgtcaataaatagtactactaattagtgtttatggttacaaaattcggaatacatgtttggccttttatgatcgaacgagacggaatgattggtcttcaaattaaaagttttattttgtgtctcatacaactgacgctagttgtatgaggtccctttttatctcataaaattgtggaccccaatcttatacttctgggtccatagaatttgggatccataaaactgtgagacaaaaagttgtcccatacaactaatgtaagttgtatgagacacaaaataaaattttccgtcttcaaaccaaaatatcaaaataaggactatataagagtacatatgatgtcttcaagttataaatattgtaggaacattaaaaaaaatctagtgaaaatattgtcacgatccaagcttttccttcgtaaactgtcgtggcgacatctactctctaccactagattagtctaacaattacggaaaaaaaataaatgtaatgacccgaccggtcgttttgaggaattaagttccgttcagcggcataaggtccgaaatagcttcggaatatgagtatcgacttgcgtgcatggtggaattcagtcttcggatggtttggagtcaattctaaggaagaaaccttgtttgggaagttagaacggtgaaaagttgaccgaaatttggacctttgtgtaaacggccccggaatgggtcgtggatgatctcaacagcttcgtatggtgattttggacttaggcgcgcatccggattcagatttggaggtccgtagagtaaattgaggcatttcggcgaaagttgaagttggaaaatgaagaagtttgacccacagttgacttttgggatatcggggtcggaatacgattccaagagttggaacagctccatcatgtcattttggacttgtctgcaaaatttggcgtcattccgagttgaattgataggtttcggcaaagggtttgatatttaaggatttgaaagttcattagctagattttttgtttgattcatcgtttcgatgtcgttttatttgatttggaacttcgagcgagtccgtgttaggttatatgacttgcgtgtgtgattagacgggggcccgggtgtgcttcggatgggctacgagtaatttccctttgttttaaaactcctgttgctgcttctggtattccttcttcgcgtacgcgatcaagccatcgcattcgcgaaggcttattttttgccacctggaaacccttctacgcgttcgcatttagagcctcgcgttcgcgaagctctgcctcactcttcaccgcgttcgcgtacctttgccaatccgcccttcgcgttcgcggacgctctcacgcgttcgcgatgagtaactggaccccctccctttttccttctccgcgaacgcgattcctcttacgcgttcgcaatgaccattttcctgggcagacagaatatatcccaaattcgagggtttcaccatttttatcatattttgacttctagagctcggttcttggcgatttttgaagggattttcacctgagcaacttggttaagtgattctcactcgatttagaccaacttccatgaatctcctcttaatttcatcctttaatttcagtttttgaatgaagaaatgggtagaacttcagagaccaaattgttgggttttgagggagtgtttgacctccgatttgagatatttttatatggttagactcgtgagagtgcgagggttctgaaaatattaaattcatccggttccgagatgttgtcctgaggggcgttttggtcattttacctaatttcgcgctttagctttgaagtaaattgtagaatcagttgcttgagatattatttacaatgtgtgatttaattgaatagatttgggccatttggagtcgagtactcgtggcaagaacgtggttgctagttgatttttgccggttttgaggtaagtatcttgcctaaccttgtgtgggggacttttccttaggatttgagtcttctgtgttgtttgaattccttgcacgcgaggtgacgagtgtgtgctcggatttatttgcggtaaattggtccttttaggctcttagacccttgaaatcactgagtatgaagttgttcttgatatgattgagttccccgttattagtttcacttcaacatgtcttacttggaatttatttgctctttgggttattcctgctgcttagttgactcctacttgtttaactggaaacgttattcctattatagctacgttatctctccaaactgcttgtctctaattggaaatcattacccttacttctcatgaaatctatttgaccttaattgaaaagaagtagatatcctatgtttaattgatactccctccgttccaatttatgtgaacccgtttgactgggcacggagtttaatatttaggggaagactttggccatgtcacttaaatctgtagcaaatgacaaaaatacccttaaaggcccactggttaccttttatacgtgttttgtggaaaatacagtaaaaagaaataaaaagtcagaacactccaacatgtcccatttcttcttacacattaatcgaggtgtccatagctttagttccaaagtcattaaattagtctcggttttttcattttttatttcatatggatctttctttttgcaaagaaaattcttctttgttttttttccttcagtcatttgtaaatttcttaataactccattttcatcctaatcgactgttagtacattaaaattatttcctgcaaaataattttaaatttatttaatttgtcacaaatcttcaaaacctttaacgtaccaataatttcaacaaataaaaaaaaccataatctgtttttttcataagggtaaatatcaaagagaagcaataatctatttatacacataagcttttcacttaaaataaaaatttgtttggcgccacaaacaaagaaaaatttaccgccatcatttcagctatccgaaatagcagcggcaaatgttctggtaacaaacttttttaaaaagaaaaaccatcgaacatgaaaaagtttgacacctgtgcacaactttttaaacattgactgttcaacttaataaaaaattcataaattgctgtaacttttatatccagtgggtccagatcagtgtttgaaagaaacgagagtaagggtaatacgggaatgctaaagttaaatggttacccaaaaaggaaagtgttcattctttttggaacggaccaaaaaggaaataggttcacataaactggaacggagggagtaattctctaattgtaattatttgtctcatgttaacttctttattgtcggatactcctcgactgtaaatccatctgtgactacgtgcaagtatgtgacaactgttatgattaccggtgtagctatcacgttttttatgtcttgacattcatgttgaggttatcgtgcttattgttctccatgaacctccttttgtattgatgtttctcttgccgggactttgttgttcttgttgttgattcccttgccaggacgttgttgctcttattgttgattcccttgccgggacttgttgtatctgttgttgactcccttgctgggatgtttttgttctcttgctgtttgtgtgcatttacattgggactacaaatgtggtattccgggagtttcccccttgtttgtttactttgggactacggatgtggtattccgggagttccccctgttatttacattgggactacggatgtggtattccgggagttcccccttgtttgtttactttgggactacagatgtgggattccggtagctccccctgcactatggtatggaactacggcaatgcagccggtagattctcccagtactgggtatggatatgttggactacgggacggtatcccgggagatccactggacagttgagaaaggactacaggacggtatcctaggagatccttatggcatcattggcattgagctgcaccttttcgtgctatttctgtatttcgttcagttgttgctgacatgtatattctgtcttgaattgctgtaattgtgcaactatttcgggcgatggccgtgttatttcttatacctactggttggtaggatccttgctagtcacatttgcacaagcatacacgtagttggactccccattagaggtgaattccttccaatttggctaagggtggagatacgccctcgtgcatccattatatgtatatatgagagcaacccgagttatgcctgttagttgtcagcatgatcgtgagatttatgggcataggttgccggtgctagacttccgatgttgggttttctcgtgagttgtggtttgtccgaagtgtaggtgatgaatgtgggaagagttgaataagaccttatgtaagcatcatcgtagtatatgagttggaaacttgttgttcttgctatgttgcgaccttaggctttggattgtgattcggccttcattcgtatcattatttattatgttctcgttgttatttgttgtctttctccttaatgtgagttatagcatttttagtcatttacacagtctttacataattacatatatcgtcttcattattcatatgattatccttttattgaccggtaggtgtcttgactgttcctcgtcactactccatcggggttagtcttgatacttactaggcaccggtgtggtatgctcatgctactcttctgcacacttttgttgtgcagatacaggtactcctattcagttctgtcagccttgggaggaggcttattcggtagagacttcgaggtatgtctgctgcgtccgcagaccgaggagtccctttccagcttctgtaatagtatgttgtttccagtatttcatttgtatagccattcttgagtcatagcctatgtacttcccttagcttgtgatttgtgagtttccgggtcttgggagttattctatatgttattgggtaaaaatgtatatgccacgcagcgttgtatacatttctcttgttttcggttattagttgttgcttttcatcatggttgttggtttccgcaatgtgttaggcttacctggtctcgccgaccaggtgccatcatgacaggttcacagttggtgaactagggtctgtgacaataaaatgcggaaaaactaataaaaactgaagataaacaatataaaggcgtttaagatgccgctcgacatatactaatacaagatctcgaaaattaaataactccccaaaatccaaagtatcatgaaatcacaagctaatgatactacatagtgctctaactccagaatgtctaaaacaaagcaaatacataagggatgttactacaagagagaatggagatggactcctcggtctgcggacgcgacagatatacctcgaagtctctaaaggatcgcctcgcctcaaggatggtagggctgagctgaagaacctggatcttcatatgaaaaacatgtgcagaaaggaccacagtggtactcagtaagtgccaagcttaacctcggtcgggtagtgatgaggaaagtcagggcactactgaatatagataaataatcaaggtaaacagtatagaatacgacaatataattcaagtgctaacagtctatatcaattaaaaacatagaaggaatctaactcggtgcacagaaatagcaacaaggggatctcccgggataccgtcccgtagtccgaatcataaagatgcagaaaaaactctcgaaatatcaatttgtagtcccaaagtaaatatctagtacaggggatctaccgggtgctgtcccatagtcccaaatataaattttcatgaggatctaccggaatacagatccgtagtcccaaagtaaataagcagggggatctcccgggataccgtcccgtagccccaaattaaacacacagcggcaacacgaacaatattcagatcaatccaatttcctaccaaggtaaaataggtatttctaacctaacatgctgcacaaaattcaaataaagcagttcaaacaaataaagcaattaagtcacttagacatgcttccctaacctaacagtaggtttaaattgcaaataatgtacaacaaggaagaaaaacaaagttatagttacttaatgaaaataggattttcaataatttgcatatgtacgtgctcgtcacctcacgcacaaggcatttcatatatcaacaacaccaaattctaatgggagttcccccacacaaggttagacaagccatttacctcgaacatgtttaaaattaaaacatgctatttccatgagtgatcgactccaaatggctcggatctattcaatttaattgcataatgtaaatataacttcaagtaactaattccactaattaattcgaagctaacatgcgaaattaataaaattgcccaaaatgtcccctgagcccatgtctcggaatcgggtaaaaattacggattatgaactaaattatccaaattcgatatcaatcccccaatcaaaattcgaaaattaagcctaagacttttccaaactttttcccaatttctcatctcaaatccgaaattagatgataaattcatgtttagattaatgggttataagcaaaaagagttaagaattattacccgtaaattccctctgaaaatctccccgaaattcatctcctaccgagatcgcaatttaatttttgttatatgaactaaaaaccctcgattttgaactttacgttctgcccagacgcgaccttaatcgcaattgtggaaactcccacgcgatctcgaagagcaacttcactaatccccaaacaaaaccctatgtgaacgagataatccctacgcgatcgcaatgttgcactactcagccctatgtgatcgcagttgacctcacgcgatcgcgaagagaaacttccacttctcagttgcctcacttcagtctcttcgcgaaggcggcatagcctacgcgttcacgattaaacttctgccaattctacacattcgcagtccctttcccacgatcgcgtagaacaaaatcccctctggctcattttagccttctcgatcgcgagcttcttcacacggtcgcgatgaagaaaagtctgcaacagaaaaccagtaaaaatcttatccttctccaagtccaaaaatggtccgttgagcattcgaaacacatctgaggcccccgggacctcaaccaaacatgccaaacaaatcctaaaacatcattcaaacttgttccaacctttggaatgctcgaaacaacatcaaacacaaatttaacatcggattcaagcttaagaacttcaaaaactatcaaaatacgcttacgataaaaaatctatcaagcctcgtccaaataacctgaaattttgcaagcatgtcacattcaacactacggagctacttcaacttctggaattttcgaccccgatattaaaatctcagtatcgaaccagaaatttcaaaaattttactttcggcatttcaagcctaaataagctacgacctccaaaacacaatcctaacacgcccttaagcccgaaatcacccaacggagctaactgaataggcggaattctattctgaggtagtcttcacattacttcgaaactcaaagcaaaatatcccggcaaatgaaactagaagaaacaaacacggggaaagcagttaataggggatcgaggcattaattcttaaaacaaccggctaggtcggtacatcctcctatacttaaacattcatctgtcctcgaacgagcatagagacatacctgaagtagtgaaaagatgagggtaacagttgctcatttcctgctcggtctcccaggttgcctcttcgaccggctgaccccgctactaaactttcactaatgcaatgttctttgacctcagcttccgaacctacctttccaatattgccactggatcctcaacataagatagacccttgtccaactagattgaactaaaatccaacatgtgtgacggatcgtcgtgatacttccggagcatcgaaacatgaaataccggatgaactcctgccaagctgggaggtaaggcaagctcataagaaaccccgtaacacgtctcgatatctcaaaagaaccaatatacctcgaactcaactttaccttcttcctaaatctcatggcgaaacccgaagtagaacccactctccaaccatataggaaatatcacgaaccttccagtccgagtaactcttctatctggactgggctgtacggagtctatcctgaatcaccttaaccttctccaaagcatcctgaaccaaatttgtgcccaataatctagcctcacccggttcaaaccaaccaaccggagatctacaccacctaccatacaaggcctcatatggtgccatctaaatgttggactgatatatgttgttgtacgcaaactccgccagtggtaagaactgatcccaagaacctccaaactccatcacacacgcacgaagcatattctcaagaatctaaatagtgcgctcatgactattcatccatctagggatgaaacgatatgctcacctccaccctagtacctaactcatactatacgaccctctagaaccgtgatgtgaactgagtacctctatctaaaatgatagaaactggaatgccatgcagacgagcaacccctggatataaatctcagccaatcgctccgagtaataggtagtgcacacatgaatggagtgtgcgggcttggtcagccaatccacaatcacccaaatggcatcgaactttctcaaagtccgtgagagcccaactataaagtccatgtgatatgatcccacttctactccgtaatctccatttgctgaagaaacccacctagtctctagtgctcatacttcacatgctgacaattgaggcaccgagctacaaacccaactatatttttcttactccgcctccaccaatagtgctgcctcaaatccttgtacatctttgtggcaaccatatagatagaataccgcaaactatgatcctcctctagaatcaactcccaaagcccatcaacattgggtacacataaccgaccctgcatcctaaatatcccgtcatcaccaatagtcacatctctgacatctactggagtgtgatctaaagtacccttccactcaactcgcggtgtacctagcattgccagcatcatggtttttgcgtgacaatcaaaaatagcataacggggtgacaaccagtccatgcccaagataatattgatatctaccatgctgagcaataataaatcggctctggtctcaaaaccactaagagcaaccaaacacgaccgataaacgaggtccacaataagagaatcctccacatgatagaaacataaacagaggaactcaaagaatcccgagatacgcccaaatgcggagcaaaataagaagacacataagaataagtggagcctagatcgaatagaaccaatgcatctctatgacaaaccaggacaatacccgtgataacagaattagaggcaacaacctcggtgctgacctaaatagcataatatctggcatggcctccctctctagggcgacctctaagtcctcgacctccacttctagctagctgggtaggtgcggtagcaactggtgctgggaccatagcctgggaactttgcggggaacgctttggctgagaggtctgtgcaggtgcacccctcctaagtctggagacctcacaatatggcgtgtttcacaacactcaaaaaaatctgtgggaggatgtgacggctatgactagcccggtccaggtctgctggacaaaccattgaaagcaccccatgcatgaggcacactagatactggaggtgcatataaggctcctgaaatctaggaggagttggaataccactggctattggaagagcagaatgaatggggcaacttatataacccataccatgacaaactaaagctagagcacgagcaccagaacaatggcccgactctcgtgacctcttggcctccctctcctccctatcccaagcatgcataccctccactctcctccctatcccaagcatgcatcccaagcagtagcagtagcagtagcagtagcagtagcagtagcagtagcagtagcagtagcagtagcagtagctgtagcagtagcagtagctgtagcagtagtagtagtagcagtagtagtagtagtagtagtagtagtagtagtagcagtagtagtagtagcagtagtagtagtagcagaagtagcagcagcagtagtagcagcagtagcagtagcagcagtagtagcagcagtagtagcagcagtagcagtagtagcagcagtagtagcagcagtagcagtagcagtagcagtagcagtagcagtagcagtagcagtagcagtagcagtagcagtagcagtagcagtagcagtagcagtagcagtagcagtagcagtagcagtagcagtagcagtagcagtagtagtagtagtagcagtagtagtagtagctggactccgatcggtactcctggtggtgggatgtgtctgtatttaggggaatcagccatgcatgagctagagtggtgtacatgctcatgaactgtgcaagagtcccctaaagagctagaatagtagtagttgtagtagtaggcgtatcaggtagttggactccggctggaactcctggtagctcttccatggcaactcgtgcaggtgctccggctgcaccacgagcgcatccttgtcttctaccccggccccggccccgacctctgacggctctagcagggggcgcgggtgcctggtcatctcgtgtagcacacatcctcaccatgtgtgagataaaagaagacagaagtttagaattgtgatatcaaaaatcttgcatgacaaggaaatgaaatgaagtgacgttttccaaacaattacatagccactcgtagataagtacatacgtcttcgtaccaatccgcgagactctaataaatcgacttgtgattcatgactcttatgaacctaggactctaatactaacttgtcatgacccaagttcgtcctccgtgaaatgtcgtgacggcacctagtctcaacgactaggtaagcctaataattgtggaagaagaaacaaaatgcggaaaaactaataacaactgaatataaacaatataaaagtgtttaagatgtctcggcatacaaatacaaaatctcaaaaactgaaaaacttcccaaaatccgcaatctcatgaattataagctaaggatactacatagtgctctaactccagaatgtctaaaacaaagcaaatacagaagggttgtaactacaagagagagtggagattgactcttcggtctgcaaatgcggcagatatacctcgaagtctctgaagaatcgcctcgcctcaaggatggtagggctgagctgaagaaccttgatctgtacctgaaaaacatgcgcagaaaggacatgagtacaccacagcgatactcagtaagtgccaggcctaatctgaatcgggtagtgatgaggaaagttagggacctactgaatatagatgaaataaacaaggtaaatagtatagaatacgacaatataatttaagtggtaacaatctatatcagttaaaaacacataaggaatctaactcagtgcagagaaataacaacaaggggatctctgaggataccgtcccgtagtctcaaccgtaaatgtccagaggatctactgggataccgtcctatagtgccaaacgtaaatgtccagaggttctccagggataccgtcccgtagtccgaattataaatatgcatggaaaactcccggaatgccaatccgtagtcccaaagaaatatccagtacaggggatctaccaggtgctatctcgtagtatcaattgcgggatcaggggcctccaacaagctgaatcatactagcaatatttgctaagttcaaaatcactctgtctcactcgagccctcggggctccaaaccaatcatgcacacaagtcctaaaatatcatacgaacttgctcgcgtgatcaaatcaccaaaataacacctagaactacgaatttagtaccaaattgcatgaaattttaaagaaagtttcaaaacttctaaattttcaaccaaaggtccgaatcacgtctaatcaatatcgttcacagataaggtataaatatcataacagacctgtaccaggctctgcaaccaaagtacgagtctgataccaacaagatcgtttaaattattacattttcagtcttaccaatttccttcaaaaatttatttctcgggttagggacctcgaaactcgattctgggcatacgcccaggtcccatattttattatggacctaccggactgcctgaatacaagtccgggtccgttttcccaaaacattgactgaagtcaacaaaaattaactttttaggccaaaaattattatttcataaattttccaaataaaggctttccggaatcacgcccagactgcgcatgcaaattgaagatagataagatgaggtttttaaggcctcagaacaaggattcgagttctaaaataaaagatgaccctttgggtcatcacattctccacctctaaaacaaccgttcgtcctcgaacgaacatataaaagtacctgagctggtgaaaagatggggatatctgctccgcatatcagactcggtctaccaggcaactgcctcaataggctgacttctctactacacacaaaccgaaggataactcttcgatctcaactgtcaaacttgtcggtctagaatagctaccggctcctcctcctaggtcaaatccttgtccaactggacaatactgaagtctaacacgtgggatggatcgttgtgatacttccaaatcatggacacgtggaacactgcatgaactgctgataaacctggtggtaacgcaattctgtaggccacctctcccactcgatcaagcatctcaaaaggccagataaacctaggtcttaacttgcccttttcccaaatcgcatcacacccttcatgggtgacacccgaagctacagtctctctcagaccagaaatgactcatcacgaaccttacggtaggcataacttttttgcctggactgagctgtatgaagtatctcctaaatgatcttaaccttatccaaggcatcctgcactaaatctgtacccaataaccgagcctcccgagctcaaaccagcctaccgggagccatttggatacttgagtgataactgttgttgtaggcaaactccgctaatggcaagaactgatcccaagaacctctaaagtcaataacactggcgtggagcatatcccccaagatctgaatagtacgctcggactgtccgtctgtttgaggatgaaatattgtgctcagctcgacccgagtacccaactcacgttgtatttccctccagaagtgcgaggtaaactgcgtaccttgatcagaaatgatagacataggcacaccatgaagacaaacgatctcacggatgtaaatctctgccaaccactccaaagaataggaaactgccacaggaatgaaatgcgctgacttggtcagcctatccacgataacccatactgcatcgaacttcctcggagtctgtgggagtccaacaacgaactctatagtgatatgcttccacttccactcaggtatctcaatcttctaaaacaaaccaccaggtctctgatgctcgtactttacttatttacaattcaaacaccgagctacatatgcaacaatatccttcttcatcctcctccaccaataatgctgccgcaagtcctgatacattagcggcgacagaatgaatagaatatcgggaactgtgggcctcttctagaatcaactcatgacgaattctatccacattaggcacagaaacacgaccttgcatcctcaaaacaccatcatctccaactgtaacccgtttggcatctccatgtcgcactgtgttcctaaggacaagtaaatgaggatcatcatattgccactccttggtacgcttaaacaaggaagatcgagtgactgtgcaagctaaaacatgattgggctcagaaatatctaacctcacgaactgattggccaaagcctgaacatctaatgcaagtggtctctcaccaactggaatatatgcaaggctacccatactgtctgacttcatactcaaagcatcaaccactacattggccttcccaggatgatacaagatggtgatatcatagtctttcaatagctccaaccaccttctctgcctcaaattgagctccttcttcttgaacaaatactgcaaactcttatgatccgtaaacatctcacacgacacgccatataaatagtgcctccaaatcttgagtgcatgaataatggatgctagctccaagtcatgaactggataattcttcccgtgaatcttcaactgccgtgaaacatatgcaataaccttgccaaagagtatttaatgtcataaagcttacaaagtgaaggttcttgacccaaaagcttccgaaagtgaagaatatttaagtcttagaatgtagctcaaaaactagacaagatgagcccacaaaatcaccataaatctatttatagagggataaaaatcgggacagaaaacggacaaaaatgccctttcaggtcagatatgctaccgcatttctatcgcaaagcagacatgtggtccgcatttttgacaagtccatcgcataatgtaaccctagtttctgggccttcactgcatttatgttttgcggtccacattgtagaaatgtgatcgcattttgcatcgcattttcttccttcaacagccttcatggttggtttgcggtttgctttgcggctcgcaaacaggttctgcggtcgcagaatgaactgtattcttaaagttgaattttgctcagcactttgctttgatctgtgatctcagtgtcaattatgcggctcgtatgtgtgttttgcgatcgcatatcatcctttgggatgcctttttgctctattcttgtctttttgtgactttttgctttcatttccatgattttgggtccttaaaccttatgtactgcaaaaacattaaaattacataagtaaaggagataagtgcatctaaaataagttaaaatctaagcaattagtattgaaatatgccaaaattctccggcacatcacgcgcacacgaacacgtggaaggaattcaaagagttatatttcaagctgaatcaaaggacgcacgataagaattcaagaatgtgaagtttttcctaaaggttctgcagcctcttgaggataaatacagacgtctctgtaccgatccgcgagactctactaaaccttctcatgactcgtgagacctatgtaacctaggctctgataccaacttgtcacgatcctaaacccggatccggtcgcgatggcgcctctcgtgaagacaaggcaagccaactattcccaattcaatttttaaaatagctaaacattaataaacagtttaagtatgaataaataaccaagaaccaagcaaaatattttataatatgcggaatacaacccaaacacaacccgataccggagtgtcataagtcactagtatctactagggtctaacaacaactgacaagtctgaatgtactgaatacaaacaacataagataaagagggagaaaagcagtgttgcaaacgccgacagctaccttgctaaactccgaagactcttcttccaacccgccaaaacccgctaccgggtgtagaaatacttgaatctgcacacaaggtgcatggagtaaagtgagtacttcgaatcagtgagtaataaaggtaaatgaaaattgagcagtaagaaatcatgtaaaacttatcaacatgttgtacagaagcaatataaaatcctttaagaaaagcaatgaagctctgaaatctctttaaacatcttagctcaattaaaacttctttaaaaatgactcttcaacagttatgcaaatgaatgcaaagcaattagtgtaggtaagcacagaaatttctcccctcggcagaaatacacaattaacaggtaaatgacagttaaatatgaaagataaacacagaaaggctcgcccctcgggtacaatgtcaacaactccgcccctcgagtaatatctcagaacaacaccagccccttgggaaatgacgtagaacagtaccagcccctcgggctatatctcacatcacactgggtacccgcactcactagggtatatagactccgggaggggcccttacgggtcaagcacaatatcaagccacctcgtggcatcataaacaggctcttgacctcatatatatataaaagccacttcgtggcgtacatatctcaggcactcggcctcataatcatatcagtgtatcactgatgtgacgtgcagcccgacccaaaagatatcctcacaacacaggccctcggccttactcagtcaaaaatcacataagcttcgcgggcaatagtaaaatatgatgctcagcccaaaaatataatatcatttcaagaattaaaggaaagtaaacatgactgagttttaaaaacagtggaaaataacatgactgaattcaattaagaagtcaaaacaatgaggaaatatcaataacaagccccgaagggttcacatagttggtactaggcccaaatatagcattcatcccaaataatgatgatagcgaacagtttccaattaaatacgcggtaaaatcatcaatcgggacggaccaagtcacaatcccctatagtacgctcgtcatcgagcgtgtgtctcacctcaatatagcactacgatgtgtaatccagggtttcaaatcctcagaacatcatttataatcattactcacctcgatcggatcaaaaccctagcccgcgatgcctcgcccgcacgaatcgacctccgaatggtccaaatctagccacaatcagtatgtagtcattaaaatatgctaagggagtgaagccccgcttgaaaatatccaatttaacatcaaaattccgaaattgctcaaacccgacccccgagcccacgcctcgaaatccgacaaaattaacatcaatggaattctcatcctctcacgagttcatacatatcaaatttaccaaaatccgacctcatatggtcattcaaattctaaaaattcactctctaatttcaagcactaaattcccaactattcctccaatttcccacaaatttttatgagtacacaatgatataatcaccataaatacaaggtataaggcccaagtagcttacctatgtggacacacttgatcccctcttgaaatcacagcttggagctccaaaatcgcgcaaaaatagtgaacaaatgactgaaaatcgcgaaggggcatttttataccttttgtccagctctatcgcacctgcgatcctataagcgcatctgcgcttccgcttctttggatttcacttatgacaccaggacccgcatctgcggtcaaaccacgcacctgcggtaccgcatttgcggtcttacgtccgcttctgcagaattcacttacctagcctacatcgcatatgcgaccaatcttccacatctgcgacaccgcaaatgcggtcaccataccacgtctgcagtctctgctcatctggccctgttttacttctgcgatagatcaccagcatctgcggcgctgcacttgcggtccccaatccgcaggtgggaaaataccagaagcagcaatatcaggtgcttcaacaaaattccaatctctccgttaaccatccgaaatcgccccgaggcccccggaacctcaaccaaaagcacaaacacaacacaccaccttatacaaatttgttccaatcatcaaaacacttcaaacaacatcaaaacaatcaaaaatacctcggattcaagcctaagtttttaaaatattccaaattccgctttggataaaaaaaaacaaccataccacgtctaaatgacctgaaattttgaacacgcatcccacatgacacaacagaactactaaaacttctggaattccattccaacctatatatcaaaatctcacctatcaaccggaaaatgctgaaatctcaatttcgccaattcaagcgtaaaccttccacggacttccaaaaagcattccgatcgcgctcctaagtcccaaatcagctaacggagctaaccaaatcataagaatttcgatccgagatcatatacaaacaagtcaaatcttggtcaacccctctcaaatttcaagcttcaactgactgtttcttccaaattcgctccgattaccctgaaaaccaaaaccaatgatttacataagtcataatacatcacatggggcaagtcatgcccgagaactggcaagcaaagtgtaaaaactcaaaacggcttgtcgggtcgttataaacaacttcaacttccaaatattatttttcaacatattcaaaaactctttttttaagttttaattaaatatatgttccagtatgtattcatttatgcttatgttttatcatgcattttcataagtgaatttcgtacttagcttcatgcaaacacatgtactatagaagatatattattcttaaatacaacatgtgatacgagatcattaaattgtaagtgtaccttataattgataaattttggacttcaccaaaaataattaaggaagtaatgatatgaaataaataaataaagttgaaaaaattaaacttgactcaagacacattatgggaaacacgtttctttcacgatccatcttatcctttcatcgatggaagttagcaataacattattctcctattggcgaaattacggttgtttgtctccttatattatcatagactctcgagataattcatatttcaagactaactatttttttagagctaaattaagtttaaaattcatttcttcgtccgagagtcggaggtgttaagcaggggctgagtaagagcattagtcgcgggttcaaacgaactcagcttaaaccttgtatttatattagaaaatacataaaatatgtactccctccattttaatttatgtgaacttatttcttttttggtccgtgccaaaaagaatgaccactttccttatttggaaacaatttatctttatgcaatgatttatagccacacaaaatatatgtgcctcattttacaccacaaattcaaaaatctttcctcttttcttaaactctgtgcccagtcaaatgggttcacataaattgaaacggagggagtataaaaatttaatcaagaaccaataattaagataaacttgagttcataattaattgagaatttataaattctaaatcctagctccgtatttggtgctaaggtgccccacatttattgagggataggttgttatatggtcttgggcaatagttggagtcactcggccatcacttatctacgaaagaggtggagtcactcgaccaccaattatctacgtcaagagttggagtcacttggcccattgtttcccattaaaacaattcgcccccagttaatattccaaattgatactatttgtcaagtggccatattgtaacgaccttgtttttgttttttcttggaaaattcctaggaaactcgtaactgctaccctttgagtacgcactggataatttgctcaatatatattagctcgcaaattacacagaagatataaatcacattaggcatgtccggtgcgacgagctttgacggagaagattgctggtaagggaaatcgatctcagatctcccatgtgggaaaccactcacccgaccaactcagtcaacctcggcgggcgtgacttcaagttaagtcttttgtgaaggctttctgtgaattcaaaataagttgttctgaacgttataattaagttctataaataggggagaaacattatttcccttttcacagcaaaaaattgaaactccaaatagctcatcaaaatgtattccaaaactattctttttctttgcttttctttggctattttgctaatagtaatatcctcacaagctgatgcaagggagatgtctaaggcggctgctccaattacccaaggtttatttacttcttcactctattacaagtatagttattttcactttttaacattttgagtctgcaaacggatgttataaattaaatgtttaaatattcaggcaacattttgctttgaattttgtgatcttatgtcataatatcttatacagaagtctctcattatgacataaatttccctttttaggttaacctatagctaatacatcataaccttttttgcagcaatggattcaaacaacattagtgatcaaaggggtgcagcaattcgtcgggcattttgtttggcttgcaaatgttgtgtcaaaaactaagaaaatgatattgtatagtcactttcaaaataatagtcgaatatatccaaaagtaggcacaacattgtggtacttataagtattagtttgtggtactggaattttaattcttgacaataaatagtactactaattagtgtttatggttacaaattcagaattcatgtttggctttttatgatcgaacgagacggaatgattggtcttcaaatcaaaatatcaaaataaggactatatgagagtacatatgacgtcttcaagtaataaatattgatggaacataaaattaaaaaaaaaatatctagtgaagatatatatagtatcaaaatttaccccatgtgactaattgaacaacacaaataaaagaactatttatatgataaaatttatgaacaattcaacaacatatgttgaataaagattacacaacacatatcagatttcttaatctggaaaacttgcgaacaatttaaaaagatcagtagaataaggaatgaacagaagtaagatttgtctatctggcaaaacttgcaaacaatttaaaaagataattaaattattataataacaagttttatccatccagaaaacttgtgaacaattaaacaatacatgcaagatttttgcatccggcaaagcttatgaagaatataacaagatagctgcagaattaagatagtaccaatttttacctatccaataaaatttggaaacaattgaacaatatatgcaaattttacccatatggcaaaaccgtaaaaaaaacttatgaaccaattttgtgataaagtcaaagttaaatttaaaagtaaaagtttatctcaatttatctgtgtaaaatcgaacacatattttctattatacttaattttagtccaatgaacaaacaataaactaaataatttcatcattatttttttatgacccggaattttcaccgccgggatcgtgatggcgtctaacattttcacttgctaggcaagccaacgttagaacagtttatccatttttaacagtttggaataaatacgaagaaagaactgtgtcacgacccggatttccatcgtcggaaccatgatgacgcctaacatcacactcgctaggcaagccaacgttagagttataatcacctttttcctttacattttcatagttaagattaacaaaagctaatcaattagaaataaaagcggaagtacatatttaactgattatccttatattattaacaaaaccgaaacagttaccaccaagaaactggtgtcacaacccacgaacattctatgaatatctacaagtaatggtctgaaagaaaaagtacatttgtcttaaaagaaaataaaacagaaatgaagaacataggaggagacgccagggccttgttgatacccaatttttttcctatgtattttttatactcaaaatatatatatatatatatatatatatatatatatatatatatatatatatatatatatatatatatatatatatatatatatatatatatatatatatatatatatatatatatatatatatatatacaaacccaagtgttttagtattttttccaatttttaaagaatttaaaaatcaatttattatctgttttagcagtacaaaaattcaataattattcttaagattatcattttggtgaataacttattttattctcatatttactccaaaataaaatttaggtgatttttgtatattttttcaaatttatttggtatttaaaagactaaattgcatataattgcaattctagcctattttaagattaatagcattttataattataaaattggtcctaatatttttaaattagtatttatatattattaattagttcagtactcttaatttatttttaaaatcattctttactattctataaaataaaaaggaaaaagctggctatttaatatctagccccaattcgtttcaattgtagccccatttacatttcaattttagcctatgattcacccaaatttcaaactcaaaatcggaccagcccaatcccatttaacccaaccccttaacccgttcatccaacccgcccggattccttttaatctaggctgttgatccttttgatcaacggccacgattacccttttcctttttaattcacctaacccaaccctaatctccccatttctttctggtagccgcctttggatactctccctttctcaaactctctcgaaggttccctggaaccctagcctctctcgtcctctccaaccataacctcacaggaatccatggcttctcaggccatggatggtctgtaccaacctcccttcacccttaaaccatgggtgttcgaagtttcgaggtctgacctcaacgatgtccgtttagatcttctcagatccgtggttttgaggcctctccggtcttgctccggcgtatctaagcgttaggagcctatctctggccttatccgactcaggatcggacttttccaggactttctcattctagggtttctctgaaaccctagttactcgaggttctctctaattattttttagatctggtatatgtctgtgctctacctgagtttcttaaacgttgtccccgattttctttcaaaaattacttctcttcgattttagggtttctgaaaggattttttcaggaaaaatctttctaattcttcttcttcttttccttatgtgtgtttgtccaaaccctgcttgtgtgatttctttttgttacgcacgtactatcttctaccttttcttttttactatgcatgttactcttgttaatccttgcttagtttcctttactcttttactatgtgtgttcaccgttaagttatttgattttgtttactagactccgttcatgttcttacatgcttcgtctacttgtgttcacgtttgtattatccccttcttctgaacctgtttaggttctgagttttctcaaatatgttcttcatgatttttcttcctttgtcgttcaaacatgctatcatatctgttttgttgagactctaatacaaatgactttctttctcacttccatgtccgattcacttttgaaaccctagtatttggggtttcctttgacgattttattttttatgttctagttaaggctccactttgggaccctggactctcagactcactatgagtcttcaaattgaacctatatcttttcgcttatgattctgaactttttaggattctgaacttctctatgattaaactctcttctaaataatttgacagtctcttcttgattcacacatttgtgtgctttatatatgagaacttttctttcaaaaggtttgccaactactaattgattccgaattcctttaatggtgtttaattgactgttactgattttccccaattgaacctttccttacctttttcctgacttggttcattcgaacaaagctaactttgattttactggcagtttgattgatcccctttccttatttttcacaaaccgtgtaccattggacttttgccttaaataaaccttgtgtatttacccatattatgttactttggaaaaggttttaataaaattctttccttaattgtcttatgcccgttcgaaatcagaatcccttaaccaaagggagactttatgtgattgattgcaaactatttccttacctttttttacttgttttctgcactataaaaggggactaccctcctgcacttgaggactttgaattgcatactcttacatacacactctcaattacaatactctttcaattatctactctcttttgagatcttttgtactgcttgcttgcaatttagcttacaagacttctgctttcacttatttatttttctgaaactggtatgtcctaattttgattctagcatcatccatatgtgtttactttacagttgctacactcttgtctacttttttgttcatgttctgtattgaatatgctactctctctttgcatatgctgtttgttgtgaactccccatacccctatccccttctatgtgtttgagttaaggtttatggcctagcagtatccaaattgatgctcaggtctgaacctgatcctcaatggatcctaactcccaaaatgtggcctagtagactggttggggtgtgccagcactccttattgctgggtatgaccaccagtttaccttggaattcccctgatttccctctattgcacttgcacttactcctagtctctaagttctgccccccctcctatgagccttgccttgggaccttgagttccctctgaacttggacatttgagggctagcccttctacactgcactataatttcattctgcaatgatatttggggtgtaagcactgcctggagttccaaagctccttggaactttgacatattccaaataagagaaaggatttggaaatctgatctttagaagttggtttatttcatatttcagacatggggtctgaattaggctttccttggttggaatctttaatttctgatgtaatttttatctttttcttattcatcctggtctataataatcttgtaataaattgctggggtgttggtgaaaaagggagggtcaatcatgcatgcaaaggggtagataccatagggaattactatacttctgaaattctgcattccacatagataccatgttcataaggaattactgtacttctgaaatgctgcattccatatagataccatgttcatagggaattactgtacttctaaaattctgcattccatatagataccatgttcatatggaattactatacttctgaaattctgcattctatatagataccatgttcatagggaattactgtacttctgaaattctgcatttcatatagataccatgtttatagagaattactgtacttttgaaattccacatttcatatagataccatgttcatagggaattaccatacttctgaaattctgcatttcatatagataccatggctataggtttttctacacttcatatagataccatgtctataagtcgtttctgaaattctacatttcgtatagataatatgcctatcggacttcctgcattttgcatatgcatctgtcactaggcaaacctgtttataggatttaaataactaactgcatatagatgacctacctataggatttctgcatgacaataacagcggttaaaatcagtaacgcctagaaaacatgcctataggagctatcaaccaaacctaaatcgtcaactcgcttataagtctaaaatcagtagctataatgtttaacgcctgcagatattatgtccttgtaattgacaattctttttatgcgatcagtttacttctttatttctgaaactaatagatatcatgcctataggttccgtttaacacctaggcaagctttagggtaaaaactataactgcatcagtctttgataattacaaccagcaggcaggcctaattcggacttcttatctaaaaatttgtgataaatcaaccggccttaatatttaagtttaatcctaattagtacgtgtaagacatggtaaactatattcttttcttttaggaggtttatttgagccatatctgcttacttgctttcccaatacttgttgtatatgttttgaatgtcgccttagaattttatccttttaaaactacaaaagccctaattccctatcctttagggttagtagtttcatatgcctccgggactgataggattgggacgggtaatagcatgcaataagtaacgatactattctgcactttaataccttaacggggtgggaagggtagatatggatatgatgactggtgcgctaatacctcatgtatcccctcttttgaggagtgattactggatattgcattgatgtgatccatattgttcataaacccgggacccccttcccttttacttgtttacgtttattttcagacttgtttaatattatttcctcaaaattcttccttccttatcttttctcaaatgagtttttacttgtttgcaacattgtgtgctcgtcccactatttgagccttaattgcttacttgtttatgtaaagtcacaatcataacatggccgggaaccacactagtggatcttgaggggtgcctaacaccttcccctcgagataatttctagcccttacccgaactctggtttcttcacctcaaacccttcttagtgtcctaatgcacttaatcattaggtggcgactcttcaaaattccaaaacccaattcctaatagggaacgagttgtcctcccaaatgtcacaagcccgatttcgcaagaaaaaggggacgcgacggcgtggcgactctgttggggattcctttaggcttttaccatttcatgttatttgtgactgtactgcctctttattgcctttacttactatctttataccttcttcttctacgaaactgacttgactcttcgtgtcttttctttcattaatgctttcttttaccgctttccttcaatattgttgtaattatgagcaattagtattgtcattatgagcgtgcaaatacatgacaatttgtttcattcttgtaattgcatcggcaatatcatattccactcgtgccaaacaaaataccatagcaacgcttataatgagtggttgcgcccttccgatattaccaacccctaaatttgacaaagtcgtatttgcgggaaaatcaatcaatcaacggtgtagtcgacggttccgtgcctttccctcttgagttgtccgctcaagggtatcagtctaataccccatagaaatcttactatgtgcaaactgcacatgcaacatagtcaaacctagtcgagtcagttatattgtccacataatgactctttaagatagccttgtccgaagtccaccgggtttccttgaaacccaaatggacgctaccatgttctgtgcatttatttggagaactaaatgccatcatgctaattgttgatatttaatagtcgagtctggtgggggtaagttcctaacatctttgtcttgcagaaaatgaggcacgagttccccagattcggcatggtcaccaacatccacccaaggttactaagctggtaggaggatcttcatacaagtgatcgaactctcgtccgcaaatatttggggaatttgccttccctcctaacaatccaacccgacaacaaaatcattgaggctgctactctattctgggacggagataggtcggtattccactttgggaacattgaaatgactcctttgctagagaaaataggaggtttggctggaattccatgggagactccaggactgcttatgccggaaaatcgcaagggtaggggtttcctcaagatgatggggttgaagaagaacccatatttgacttgtttgaaggattcttacattcctttcgattatctgtacgaaaggtatggctatagaaagtcctagcgcacttactcggatgaattcgtcctcacctcactggggcatatccacagaagggtcttcgtctttatgttttgcttcttggggatgatagtgtttcctaggaagaaggctaggatcaatcccagattggccatggtaactaggacactaatggaaggaattgatggacaaccctttagcatagtacctatgatcctcgcagaaatatatcgagccctggagaaccgttaatgatgggccaagcactttgagggttctaacttattactccaactctggctcgtggaacacctccaaaagggtgagtatcgacaaaacatttttcgcagggactgggatgatcgtatcgccttccatcagccgagacaaatgaactatatgcctaacatgatcgctcagccagaagatgccaaagggtgggtaaagttgttcgataacctggaagaggaccaagtgaaatggatgtttgaatggttccccactgaaaagttcattacccgatccagggaggcaccgttccttatacttatcggtctgaggggaacttacccttacgttcctctccgagtcaggagacaggcagggaggaagcagattataccaagggtcgaaaagatgatccactccagagacgactttcaagacgacgatagtccatacaagtgtcaagctcaacacatgtgccattgcaaaatcgtcctgggaagggactccattgaaccagacaagtaccacgccggttatactccatactacctggattggttggaagacaggcgagatgggttagaccaaccggggtttgttcgagtcacaggattatcgacgaaaaggctgaagcacaggtcaagtataaccagctgcgtaagaggattcgggaaagcgaaagtgagcatcaggaaattcaagaagctcatcaaaagctgattgaagaatggaaagatatggctattcgcgccaacaagcgactgggtacctagagcaaggtttagtggagctggaaggaaagttcatcagaaggattgaagactgtcaaaacgctgaaggaaatgcgggcggacatctggcccgagcttatttgctgctaggacttcgctagatgatgaagctgttagatagagctaaaaatgccgagtctggggaaggtccttctgggactaagtagttaggagtctttctttcttgcttttaatgtaataaggccaatggccattagtgacatttttactttttgttattttagtgtcattttgggattcgacttattttatcaataaaatgaggcatttagcattataagttctccaaattaactgtcgctaggcctacctcgggcacaatgaggctccccaattaggatacgctttatattcctgtactaggtgtttaaatattgcaatgctttcccctcatgatccgcactaacttgttacctttttgttttttacttttatttttattcccctccccaaaggttagttcgttcactctggcatcatcatcatacaccacaagatccaagggccctccacctcctcctcctccgagtcatatccgaaacaaaaacaggggaaaaatggaagatttgaacaacatcagaaaggagaacacaactgaaagggtagaggttcctcagggtactcaggtttccaagcagaatgtctcccagctcgatcaaaagttattgaaatttaaggaagaactagaccaagttcggaacttggcaaatttgtcattttcccttaccacgcccgatatcaactttcccaacacctaaaatcacgcacaaacacagaaaatcccgaaaccacaaacctcctgaggggtacaaacctcccaagtttgaaatgtttgatggcacaggggatcctaaagtccatttgaggacgtattgcgacaagctggtcggagtcagaagggatgaaaagatccgcatgaagctctttatgagaagtctgaaaggggatgctctatcttggtacatcagacaagaccccaagaagtggacaagctgggtaggtatggtgtccgatttcatagataggttcagattcaatacggagaatgcaccagatgtattctacatccagaatttgaagaagaaacctatagagacattccgcgagtatgctacttattggagatcagaggctgctaaggtcaggccggctttagaagaagaacatatacacaggttttttgtccaagctcaggacccacaatattatgagaggttgattctgatcgagggtcagaaattctccgacatcatcaagctaggggaaagaatctaggaaggtattaaaaccggtatggtcaccaatcttgaagcattacaggctaccaataaggctctacagtctggcggcacgtccaataaaatggatgtgagtgccgtgatggttgcacagagaacaaaatgtccaataaaataccaaacctacacattaactccacctatatattagcctaccccaaattaccaagcaccctcaccctcctaccaagctccaccacccgcttattaaacacctccacctcccacatatcagcccacttcacccagatactctcaacccgcacctgtctaccaagcctatcatgctcaaccctctcgctatcaatcagctcccactcgccaaaacttccctagacctagaccaaattttgaccgtagacctcccaaacaatacacagccatcgccgaaccaattgaccggctgtataaaaggctcaaagttgctggttacgtcacccttttccctgtcataactcctgaaaatccttcccaatggatcaacccgaacaaaacctgggcatacaattccggcatgaaggggcataccattgacgagtgccgctcgctgaagtataagatccaagctttaattgacaacaagatcatcgtggcaaaggatcctgctcccaatgttcgcaacaaccctctgcctgaccacaagggtggaggtgttcacacgatcgagatagaagatgattggaccccaaaggatcgattggattaattgttgaaggtgacgaaccaaagaaaccaacagtcacacttaatccgctcattgtccagatccagccttctggggatgatgaagtaaacatgtctatatcgcttgagtttgaagcacctctttctgcaaaggcgccaggactaattgaggtcgagttcgaatccccgaaagcaccggtacaatttgaagtgaccgtattaccttccaaagcaagggtacccattccagtagctatgtcaaccatagcaccattccatacgaatgtcattccttgggattactgataaatatgattttaacatgtttcatgcccctacttgcctatgctttgagtatcatttacttcaaaatagacccaaaatgctcacaggttgtgcttgattgcaggtttgaacaacgaagtgatgaaatgtcaaagatgagctcaaaatggagtgaaacctgctcaagtgtcaaaggcaaagtaaactgctaggaaaaggaacctagtgcggaccacaaaaatgtgcacgcggtcgcactaggaggttcagtgaagtgcagaattaagtctagcaccacgcggccgcggtaggaaatatgtggcccgcattctgttcacacggacgcaccattatggcatgcggcccgcatcaaaatgttcagagagtcaaagactttagcaaaagcacacctcgcggccgcggtcatcatcacacggtccgcgtcaaagcatctcgcaggccgcgctacactttctcgcggtccgcgccaggcacttcagagagcatgaaatggaagtcaaacaaccagtacggccatggtcataattgtgcggcccgcactgacacggcaagggcaattttatccagttttttcagcccactataaatagaacatttttatttaagctgcgctcatgaggaccattgttttagcctttttggcattttaacattaatttctccataaattcttgtagttttattctagtaattaattgatatggttatttcttcttctatttctttagtttctctttcaattatgtctagctaaacccattagctagggttgtggctcaaccctagtgtgggtaattgatgggtgtggccatctaatgatagattgatattgggtgtttattatttgggttaattttatgctttagttaaggattggtggttgcaacactgattctagcttagtggattttgactcttcttgagaaagagagtctatgaccccaaaattgacccaacaaggaattcggatggacctatgagaaatggtagtcccaattaacgggttaaacctcgagagagtaattacccaacttgaaccctagttgtttggtcaaattgacctacccaattggtctctcgagagccaattaggcaaaatcactctctctaccaagaggtgtgagaatgggtgcaattatgcaacggttataacataatccccataatcgtcaatctacccttagtagtctctacccgttagttaaccacctaggtgatgccataatcctagtgccctttctatatattaattacaacttagaaaatatccctttagcataagttattcttaatctttagttgataatagtagttgttaaagaaaggaaaacccaaaaatgttaggagtacaattaggagcacaaacatacctctaagctaagcagacattgcaactccatcactagctccctgtggaaaatcgatctcgaaccactattcgggtaaaagttgtagtgacccactcttcctacattagtgtaacgttgagttagcagcgatcaattacacggccgaagcaagaaggaaagggaaatcaaaaactggagaagcaattgcggcacaaggtatgaccagaaccggtagggtttacactccagaacacctagctgagtctagtaagcaagcctctggacgaccgaccgtcactgaaactgggcctgatgacctctggaggaagatacaagcaaaggagtattcggtcataaaacaactgaacaaaacgacatcccaaatctctatcttagccttgttacaaagctctaacgcacataagaatgccttattgaaggtgctaagtggggcatatatgcccagcaacataactggaggagaaatgacgaacatggtagggcaagtactggagagtcataaaatcactttccacgaggatgagccacaagaaggcattacacatcactgtgcaatgcgaagattattttatcactagagttttgatcgacggagggtccagcctcaatatctgtccgttgataactcttagaacattggggaagagcctgcatgggatcaaagatgggaccatcaatgtcaaagctttcgatgggtcccaaaggtccactattggggaaatcagtttatgtttgcaaatgggaccaacttggttcgacgttgactttcaagtgataaacgtcacaacatcttacaacttgctattggggcgaccctggattcatgctgcaggagctgtagcctcaaccctgctccaagcagtgaagttcgaatggaatcaccaagaggtgattattcatggcgatggtagagaccccatatacagtcgccagaccatcccgatgatccgagaaagaaggaaaataggcggagaaacttaccaccacattgagcgagtcaacgccgtggataaggataaattgtgggatagcaagattgaaagtatactatattggtgtggatatcagcctggaaagggacttggcaaaaacctccagagaattgccaaacccatcaagctgaagaaacatggtactacttttggtttggggtatgaatacacctagaaagagttcgatgaatggtcgccaccatggcacggtccctactatccactggagcatccgatacctcgtctggagcagactttccaaccggcagatgtcatatacgagtcagaagaagaggaagcattggcggaaatgaggaatctgtttctgaaagacgacaatatggattgctgtgtcattttcaatgaggaaggggaggaaggcccttccatacaagctgtgagccaaggatcacacctaataattggtccatcagaaccaacagggcccggaaagcttcggagtagcaggctgaacaaagcaccgtgcattatattttactttttgctagctgattttctttccgtattttctttaacttcgaaaagagctccgatgttcaaaacaattatgaaatttatcaaagcatttcaatttcttataaatctcgctcttattattttctctatcattttctttatttacatagcattactattacttatcttgatgaaccgacgattgtgacttgcaatgaggtaacgtaacaaacggacatagactcagaagaggatgatataccagaagaggtcattaaagaggttcaccccgtacgaggcccggtattccctattggaacacacctgttgtgctctgacttgggtagctcagaagttgaggcattatttctgtgcctatactacttatctcatatccagaatggtcccgctgaagtatatcttccagaagcccatgcccgccggcaagctagccaagtggcaaatcctgttaagtgaatttgacattgtttacgtatctcagaagacaatcaaaggacaagccttggcagatcatctcgccaagaatcccgtgggtggagaatacgaacctctaaagacgtattttcctgatgaagaggtatctttcataggagaagatattgcagaatcctatgatggttggagaatgtttttcgacggagcaacaaatttcaaaggagttggcataagagcagtcctagtatcagaaaccggtcagcattatccggtatctgccaaactcaggttcccgtgcaccaataatatggctgaatatgaagcgtgcatcttagggctcaagctggccattgacatgaatatttaggaatttctagtaatcggaaattcagacttgctcatacatcatgttcgagaaaaatgggcaaccaagaactctaagatacttccttatctgcatcacatacaggagttgaggaagagatttacaaagacagagtttcagcatgtccccagagtgcagaatgagttcgctgatgcattggctactctatcatctatgagtcaacatctagataagaatttcattgatcccatcccggtaaaaatttatgaccagccagcttattgtgctcatgtcgcggaagaagcagacggaaaagcgtggttctatgacatcaaggaatatttgacaacatgagaatacccagagctttcaaacgctactcagaagcgcacccttcggaggttatctaacagctttctttcacagtggaggaatcttgtacgggaggactcccgatttgggattactaaggtgtgtcgaagcaaaggaagcatccaggttattagacgaagtgcatgcagggacctgcggtccgcacatgaatgattttgtcttagcaaagaagatactccgggcaggttatttttggatgaatatggaacggactgcatccagcatgtccgaaagttccatcgctgtcagatacacgcaggaatgataaatgtgcgtctaaaggagctcactgtaacaagctcaccatggccattcgccacttggggaatggatgttatcggacctatcgagcctaccgcatcaaacgggcacatgttcatcctggtggaaattgattatttcaccaaatgggtcgaagcagcatcatacagggtaactaagaaggttgtggcagactttgtccgcgaccgtatcatttgtcggttcggcatcccagagtcaatcattactgatattggttcaaatctcaatagtgacctgatgaaagctatgtgtgaaacgttcaaaatcaaacacaagaactctacaacctacaggccttagatgaatggagctgaagaggcggccaacaagaatatcaagaatatactgaggaaaatgatagaaaagcataagcagtggcatgagaagctatcatttgctttattgggataccgcaccacagtccgcacatcaactgaggcaactccctacatgctggtttatggtacagaggcggtcattcccgccgaggtggaaattccctccttgaggatcatacaagaagcagagttggatgatgcagaatgggtaaaaagtcgctacgagcagttagcccttatagatgggaaaagaatgaatgcagtttgccatagtcaattatatcagaacagaatgtctagagctttcaacaaaagagtcaagccgaggaagttcacaccagggcagctggtgctgaagaaaatatttccacatcaagatgaagccaaggggaaattctctcccagttggtaaggtccgtacatggttcaccgggtcctaataggaggagcccttatacttgcagaaatggacggagaagtctggccgaagcccatccattcagatgcagtcaaatgatactatgtgtaacctttatgctttctctttgtgatgtaatttgaactacgcctgacctgattcccgtttaagaggggatacgtaggcagccctatgggttcggtcacaattcaataaaattttcattttccccgccattggaaactggggcagaattttgaggaagaccctcaaaattccgaagttgatttttagccattcaacgcacgcagccgtcggaagctccagcccagtaaactggggtagaattttgaggaggacaatcaaaattccgtagtgaaagaggttgcaatgtcttgaaccgcggcacagtcgtcggttcatctaaaagaaaactattttcaattatgtatttatgttacatatttttaatcatgcatgagtattatcaaaatttctttgtttggaaacactaccccaatgaaaacaagagccgagaagggcgagcatagtccatgggaagacgaactaaccttcccccttttaaaaaactcacgatttttctttggatgcaggatctcaagtcgtgaaatcagcagatatatatttttatacactcatgctttttcaggaatacaactcctcagaatcatcacctatttacaattgctatccatagacgatatccctagcagccacaatatcgcaatcagctatcagctaagagattttactaccgtttgcccttttactttccttcattacataaggctacttttctgccttccgagactaagcattgtctccatctgcatttctctgcattttgcataaggctacctttctgccttccgaggttaagctctacctccatctacatttctttgcattttgcataaggctacatttctgccttccgaggttaagatctacctccatctgcatttctctgcattttgcataaggctactcttctgccttccgagactaagcattgtctccatctacatttcctgcattacataaggctacttttctgccttctgagacttagcattttctccatctgcatttctcctacatttctgccttccgagactaagcattgtctccttctgcatctctctgcattgcataaggctacttttctgcctttcgagactaagcattgtctccatctgcatttttctgcattttgcataaggctacctttctgccttccgaggttaaactctacctccatctacatttcctgcattgcataaggctacttttctgtctttcgagactaagcattgtctccatctgcatctatctgcattgcataaggctacttttctgccttccgagactaagcattgtctccatctgcatccctctacattgcataaggctacttttctgccttccgaggttaagctctacctccatcctgcatggatgaaatattgccactttattttgcttgcatggatgaaataccgctgcctttttacgtcttgcatcgactgaaatatcgccacctttatttaaatcccgcatcggctgaaagatcgccaccttttgcattttatgggctgaaagatcgccaacctatccgaaggcgtcattgttcggaggcaccatttccatagcccgagaatgccataccatggcctgaggaccccgcttttatcttttgcatattattattcaaaggcatcatggttcggaggcatcatcctcatagcccgagaacatcatttcatagcctatgaatcctttattatacgcttcatggcccaagacgtcatggtctgagggcgtcatcctaaccgtccaaagacagcattcattgtccaatgggaacttgcatcacgtttaaatttctgcacaatatatgtttgtattactcgctgtcacgaccctagttcaccatccgtgaacacgtcatgacggcacccagtcatgatgactatgtaagcctaacaatgcggaaataacaacctttacgaaaataatgaattaaaagctaaataacttaaggaaatgtatataatatataatttgccgcttggcacatacactttaacaccacaaattctgaaatagaaatcccaaaacccggaatctcacgggaaacacaggctatagaaagtatatataatacgactctaactccgaaaatgtctacagcaatgaaaaacaagaaaagctagctaactacaagatagaataggaaggagactcttcgatatgcgaacacggtagatatacctcaagtctccgaatctctcttctgaatcactgatagtgtgcctgagcggaggtacctggatctgtacatgaataacatgcgcagaagaggcgtgagtacaccacagcgatactcagtaagttccaagcctaacctcggtcgggtagtgacgaggaaggtcagggccctactgagaataaatatgataataataatgtacagtataagagcaggtaaaaataatggaacaacagcgagataagacagaaactacaagtcaacaaaaattaagcaataataaagaataatgcagccaggtacaactcaatattaggatgccatgaggaactcccaggataccgtcctgtagtccttttctcaactgtctagtggatctcccgggataccgtcccgtagtccatcatatttgtttatcagaaggatctcccgggataccgtcccatagtccatcatatctgtttatccgacggatctcccgggataccgtcccgtagtccaaccatcaatgtatagggggatctatcgggaatcaaacccgcagtcccaaaataaacaaacaagggggagctaccggaatcccacatccgtagtcccaatgtaaatgcgcaatcacaacaaaaggatattcagaattcaagtataaaacaccaacaaataggtagtactagcctaacatgcttcacgtaatacaatttaggcaaaatggacaaataagcagttaaatctaactaatcatgcttttctaactaacacaggttaaacttgcatttagaatagtcaagtaagcaagaaaacacagtttgaatatttcacgtaaagcggatttccagtaattagctcaattacacgctcgacacctcgcgcacaaggcatttaaaacatcaaatatcatatcctaaggggcgaggtcccccacacaaagttagacaagccacttacctcgaaccggtacaaaatcaagtggaaaccacgctcttgccacgagtatccgactccgaatggcccaaatctatgcaattcaattacataacgtaaataacatcgcaaacaactgattccactattaaaattaaagctaagacgcgaaaataggtaaaataaccaaaacgcccctcagaccaacatcttggaatcgaataatttttacattttcaaaaccctcgtactctcacgagtctaaccatatacaaatctcccaaatcggaggtcaaatgcccactcaaaactcaaaagtttagccaataaagttttacccaatttttcccaaattgatcttcaattcgaattttaataatggattaaactagatattgatggattacaactaaatagggtttaaaaaacgttacccagtgatcttcgcttcaaaaccctctcaaaatcgccctctcccgagctccaaattggtttttctaactttagaacttaaccctcagatttctcttttcagaacagttgtttccgcatctgcagtttcctttccgcatctgcgactactgcttctgcgatttccatacacttctgcggaacttcactattacgcccggaccgcttctgcggtgccacatctgtggaccaagtgccgcttctgtggctcctgccaaactgctccaattctgcttctgcggtgccaaggccgcttttgcggctccgcttctgcggttcccaagccgcagaagcgaaaataccagaagacagaagtcttcagctgctgcacactttagaattttctccgttaaccacccaaaatcatcccgaggcccccgggacctcaaccaaaagcaccaataccacctaatacctcattcaaacttgcatcaatccttaaaacacctaaaacaacaccggaaacccgattaaatcaatgattcaagcctaagaacttcaaatttcaaccaaacttgctttcgatcaaaaacctaaccaaaacatgtccgattgaccagaaattttgtacgcatgtttcaaatgatatgacggtgctacagcaacttccggaattccattctgaccctcggatcaaaaattcactatcggaccggaaacttcaaaattctaactttcggcatttctagcctaagtgagctacggacctccaaaatacgttccggacacgctcccaaccccgaaatcacctaacggagctaacggaaccatcggatttccattccgaggctgtcttgataccgttctaattacggaccacattccaacacttaagctctcatttagggactaagtgtcccaaaacactccgaatcctaacaccgaacgtcccggcaaaccagaatagcagaaatgaacttaggggaaacagttaatagggaaacggggcgtaaatactaaaaacgaccggccgggtcgtcgcactcgcttgcaggtaaaccggctagcaacgaccgtctcagtaggagcgatcccgctccgattcccgcgacctgtcagacttcaactacctttctcaacccaaacatcgcgtccgttcttttcgaaaatctccatcgacaaatttcgtctatggatcctaaactacatatggcctgattcctctaaaatcagggatatgtaggcagctcaggagccaaagatcggtcaaaattctttgcaaatcatctcttcggtcaaaattggccatcatatctttatccagcaactctttcatccttctcaagtaaagaggggcagttgttgatacccaattttttccctatgtattttttatattcaaaatactttcaaaataacatagaattatcattttggtgaataatttattttattctcatatttacaccaaaatacaattcaagtgatttttgtatattttttacaaatttatttggtatttaaaagactaaattgcatataattgtaattctagcctatttgaagattaatagcattttataattataaaattggtcctaatatttttaaattagtatttatatattattaattagttcagtactcttaatttgtttttaaaattattctttactattttataaaataaaaaggaaaaagctggctagccccaattcgtttcaattgtagccccatttacatttcaattttagactaagattgacccaaatttcaaactcaaaatcagaccagcccaatcccatttaacccaaccccttaacccgttcatccaacccgcccgaattccttttaatccaggccgttgatccttttgatcaacggccacgattgcccatttcctttttaattcacctaaccgaacactaatccccccatttctttctggtagccgcctttggatactctccctctctcaaactctctctaaggttccttgtaaccctagcccctttcgtccttttcgaccataacctcaccggaatccatggcttctcaggccatggatggcctgtaccaacctctcttcacccttaaaccttggatgtttgaagtttcaaggtatgacctcaacgatgtccattcagatcttctcagatccgtggttttgaggcctctccagccttgctccggcgtatctatgtgttaggagcctatctttgaccttatccgactcaggatcggacttttccaggactttctcattctagggtttttctgaaaccctagttactcgaggttctctcaaattatttttttgatctggtatatgtctgtgctctacctgagtttcttaaacgtttcccccgattttctataaaaaattacttctcttcgattttagggtttctgataggtttttttggggaaaaatctttcggattattcttcttctttgccttatgtgtgtttgtccgtaccctgctcgtgtgatttctttttattacgcatgtactatcttctaccttttcttttctactatgcatgttactcttgttaatccttgcttagtttccttcactcttttactatgtgtgttcaccgttaagttatttgatttattttactggactctgttcatgttcttacatgcttcttctacttgtgttcacatttgtattatccccttcttctaaacctgtttaggttccgagttttctcagatatgttattcatgatttttcttcctttgtcgttcaaacatgctatcatatctgctttgttgagactctgaaacaaatgacttgctttatcacttccatgtctgacttgctttcctttgacgattttgatttttgtgttcgggttaaggctccactttgggaacctggactctcagactcactatgagtttgcaaattgaacctgtatctcttcgcttatgattctgaactttttaggattctaaacttctctatgattaaactctcttctaaacaatttgatagtctcttcttgattcacacatttgtgtgctttatatatgacaacttttctttcaaaaggttttgccaactactaattgattctgaattcctttaatggtgtttacttgattgttacttatttttcccaattgaacctttcattacccttttcctgagttggtttattcgataaaagctttcaactttgattttactggctgtttgattgatcccatttccttatttttcacaaaccgtgtaccattggacttttgccttaaataaatcctgtgattttacccttattatgttactttggaaaaggttttaatcaaattctttccttaattgtcttatgcccgttcaaaatcagaatcacttaaccaaagggagacattatgagattgattgcaaactatttccttacatttttacttgttttctgcactttaaaaggggactacccttctgaacttggggacacttcgaattgcatactcttacatacacactctcaattataatactctttcaattctctactctcttatgtgatcttttgtactgcttgcttgcaatttggcttacaatgcttctgctttcacttatttgtttccctgaaactggtatgtcctaattttgattctagcatcatccctatgtgtttactttacagttgctacactcttgtctactttgttgttcatgttctgtattgaatatgctactatctctttccatctgctgtttgttatgaattccccatacccacactcccttctatgtgtttgagttaaggtttatggcctggcaatatccaaattgctgctcaggtctgaacctgatcctcaatggatcctaactcagaaatgtggcctagtagactggttgttattgctgggtatgaccactagtttaccctggacttcccctaattccccactattgcacttgcacttactcctagtctctaagttctgcccccctcctatgagccttgccttgggaccttgagttccctctgaacttggatatttgagggctgtcccttccacactgcactataatatgattctacaatgatatttggggtgtaagcactgcctggagttcttgaagctccttggaactttgacacatcccaaataagagaaaggcttcggaaatctgatctttgaaagttggtttatttcacatttcagacctggggtctgaattaggctctcctttgttggaatctttaatttctgatgtaatttttatctttttcttattcattctggtctataataatcttgtaataaactgctggggtgttagtgaaaaagggagggtcaatcatgcatgcaaaggggaagataccataaggaattactatacttctaaaattctacattccatatagataccatgttcatagggaattactgtacttctaaaatgctgcattccatatagataccatgttcatagggaattactgtacttctgaaattctgcattccatatagataccatgttcatagggaattactgtacttctgaaattctgtatttcatatagcatgttcatagggaattattctgaaattctgcatttcatatagataccatggctataggtttttctgcacttcatatagataccatgtctataagtcgtttctgaaattctgcatttcgtatagataatatgtctatcggacttcctgcattttgcatatgcatttgtcactaggcagacctgtttataggatttaaataaccaactgcatatagatgacctacctataggatttctgcatgacaataacaatgcttaaaatcagtaacgcctagaaaagcatgcctatatgagctatcaaccaaacctgaatcttcaactcgcttataagtctaaaattagtagcaataatgtttaacgcctgcagatattatgtccttgtaattgataattctttttctgcgatcagtttacttctttatttctaaaactaatagatataatgcctataggttccgtttaacacctaggaaagctttagggtaaaaactataactgcatcagtctttgataattacaaccagcaagcaggcctaattcggacttcttatctgaaaatatgtgataaatcagccttcactagtgcttaagtttaattcagacctaatcagtacgtgtaagacatgctaaactatatgcttttcttttaggaggtttatttgagctatatctgcttacttgctttcccaatactttccgtatatgttttgaatgtcgccttagaattttattcttttaaaactgcaaaagccccaagtcccacccctttaggattagtagtcccatatgcctctgggactgataggattgggacgggtaataacatgcaataagtaacgatactattccgcgctttaataccttaacggggtgggaaaggtagatatggatatgatgaccggtgcgctaatacctcatgtatcccctcctttgaggagtgattactgggtattgcattgatgtgatccatatgttcataaacctagaacccccttcccttttacttgtttacgtttattttcagacttgattaaaattatttcctcaaaattctgccttccttatcttttctcaaatgtgtttttacctatttgcaacattgtgtgctagtcccactatttgagccttaattgcttacttgtttatgtaaagtcacaatcataacatggccgggaaccacactagtggatcttgaggggtgcctaataccttcccctcgagataatttctagcccttacccgaaccctggttccttcaactcaaacccttcttagtgtcctaatgcacttaatcattaggtggggactcttcaaaattccaaaacccagttcccaaaagggaacgagttgtcctcccaaacgtcacaagcccgatttcgcgagaaaagggggcgagacaggcctgcggacgcctgcaagactaccttgggtctcctaggtgaatacttgccaccgaccttgcgatcggccacaaccagctccaaaatctgcacagaaaatgcagagtcaagcatcactacaaccgaccctatgtaatggtaagtgtcgagcctaacctcgacgaggtagtgacgaggctaaggcggggcatatacgatataacctgcatacagttgataataaagcaaaaggaagtacaaaccgaaatagaatagtaatttctagtaaaataacaatggaactaaattatcttgccagtactcagttataaccaatccttaagagaattacaatgctacagaatagaatcatagcagagggaaaaatacataagcaacaaaatgatatttcaccatacaatcagtaacaatatgaacattcatcttattactccttgttgcatcgtccaacccgatcccaccaatccactcgtattactcctcaatatatcacccttattcctcctgttgcagcgtgcaacccaattccacatgtccacccttattactacttgttgaggagcgcaacccgatcccaccagacaatcacagttcacccttattcctccttttgtggcgtataacccgatcccattatatcagtgccaatcacacaataagaatagaaatttcatagtttagcgcaaaaaccttccacaatatatgaacctcaaaccaagtcaaacagaagactatataattatgaaacctcattccgttattattacacagcgaggccaaccgaaatatactatgaaacaccggtaaatcagcttaaccaataatgtaacacaatgatactacggaataactattaccttcaataaataaaccaacatctaacaggaagcacttagacatataagcatcaataagcatgaaacaattaagacatgaagataatatattgggaaccgggaagggaacaaactaaacaagtaatttggcggcgcataggtactggtcaccacacctatacgccacgcacatggaatttcacatagcaatcaagttggggaaccctaatccctcgagtcaaagctagaccaaacacttacctcaatccaaccggcaattcaaagctcaattaccgctttacctctcgattccacctccaatccacttgtatctagtcataactaaattaataacatcaattactgctacagaaatcaattctgatgcacaattataggtttcccaatattttttccaaaaagtaaaaaatagaccccgggcccgcttggtcaaaaaacgaggttcaaaccaaaacccattcactcattcacccacgaacccaaatatgtaattagtttcggaatccgaccctaaattgaggtctaaatcccaatatacgaaaatccctaattctacccaaaccctcaatttccaccataaaaatcctagattctaggatgaaatcttgtgaaaagaagtaaaagattgaaaaaaatgaattaagaatcattttcctatgatttgggaaagaagtagcttttggaaaatcgcctcttgaagtttaggttttgaaaaatggggagaatgaatgaaaattcctgtctaagtccaaagttatcagctgcagatgtcgcatttgcgacctgagctttgcaaatgcgaaggagccatcgcaaatgtgaagcccttcacagttatactgccttcgcaaatgcgaggaaagtatcgcatttgcgagcaccgtcccttgcaattgcgagtaaaagattgcatttgcgatcatatgcctcccagtctcccttcgcaattgcgaaggtttgttcgcatttgtgaactctgccggcctagccttctaatcgcaattgcgatgaaaggctcgcaaatgcagaccctgctgggctcgcaattgcgatgccttatctcgcaattgtgagttaaggggcctgcaacaagctgaagcataccagcaatattctctatgtttcaaatcactccgtagcctattcgaaacttacccgagccatcggcgctctaaaccaattatgcacataagttctaaacatcatacgaactttctcgcgcgatcagatcgccaaaataatacctagaactacgaatctaataccaaattgcatgaaattttcaagaaagtttcaaaacttcgaacttttcaaccaaaggtctgaatcatgtcaatcagtctcatctttcaccaaatttcacagataaggtatacatatcataacggacctgtacggagctcccgatccaaaatacgggcccgataccaacaagatcaaatcctttaaattattacattttcagtcttatcaattttcttcaagaattcatttctcgggctagggacctcagaatttgattttcgggcatacgcccagatcccatattttactacggacctatcaggaccgtcaaaatacagtttcggatccgtttacaaaaaatgttgaccgaagtcaacaaaaattaactttttaggccaaaattgttatttcataaattttccaaataaaggcttttcggaatcatgcgcggactgcgcacggaaattgatgagagataagatgatgtttttaaggcctcagaatatggattcgagttctaaaacagaagataaccctttgggtcatcacattctccacctctaaaataatcgttcgtcctcgaacaaacatcgaaaagtacctgagccggtgaaaagatggggatatctgctctgcatattgtactcggactcccatgtagctaccttagtaggctgacctctccactacacatgaactaaaggataactcttcattctcaactgtcgaacctgcaggtctagaatagctaccggctcctccttgtaggtcaaattcttgtccaactagacagtactgaagtctaacacgtaggatggatcgccgtgatacttccgaagcatggacacctggaacgctggatgcactgctgataaacctgctggaaacgcaagtctgtaggccacctctcccactcgatcaaggatctcaaaaggccctatgaacctagggcttaactttcccttcttcccaaatcgcatcactcccttcatgggtgatactcgaagcaacgctttatctccgaccataaatgccacatcacgaaccttgcggtcggcataactctttttcctggaccgagctgtacgaagtctctactgaatgatcttaaccttatccaaggcatcatacactaaatctatacctaataaccgagcctccccggctcaaaccaccctaccggcgatcgacaccgtctaccatacaatacctcagagggagccatctggatgctcgactgatacctgttgttataggaatacttcgctaacggcaagaactaatccaagaacctccaaagtcaataacacaggcgcagagcatatcctccaagatttgaatagtatgctcggactgtccgtccgtctgaggatgaaatgatgtgccaagctcaaaccgtgtaccaaacttacgatgtacttccccctagaagagtgaggtaaactgcgtacctcgatcagaaatgatggacacgggcaaaccatgaagacgaacgatctcacagatataaatctctaccaaccgctctgaagaataggaaactgccacaggaatgaaatgtactgacttggtcagcctatccccaataacccatactgcatcgaacttcttctgagtccatgggagtccaacaacgaagtccatagtgatatgctcccacttccactcaggtatctcaatcttctgaagcaaaccgccaggtctctgatgctcgtacattacttgctgacatttcaaacaccgagctacatatgcaaaaatatccttcttcatcatcctccgccaataatgctatagcaagtcctgataattttaatggcgcccgaatgaatagaatactgggacctatgggcctcctctagaatcaactcacgaatcccatccacattaggcacacagatacggccctgcatcctcaaaactccatcatctccaactgtaacctgcttggcatctccgtgccgcactgtctccctaaggacaagtatatgaggtcatcatactgttgctcctatcttacccgaaaaggggtataagggagtttttccaatttaagtgatattaaatcgaaatgagattattttatttatttcagagtcgctgcttgagataatttatggtgtgccaagtcactagtttattttaaatcccaaatcaaggaaatttgacttttatttatggtctgcgaacatagaagatcgagtaaggaattctgttaacccgagagaaggtgctagcatttccgggttccgtggttttagcacggaatctcaactattattaattagcctaattatcttattaattacatgttttaaacctgttgtgtatttttaacttttttttatttgcaccgggtgtccgagtctcttcgagccccgactaatcccgggggtgcacaagccctcaacaacgagtttttcgcaagtgcaccacagttaattcaggtattacccagtccgatggccctcagaaattatttgcacccagtgagtttcgaacttgagaccttgaaagggagcaaactccaaggctcaagtcaattgccaccaggccaacccctgagtgttaaatatttttaactttataattgcttttatttatttaaccgctttttaggatttatggaatttatttgaacaaatcacgatgtcgtgcagtcattgtttttatacatattgcaaatcgcgtcacatgaaatgcacccgcgatatacaatatgtttattttaatcattattcgaagttatggtcgggtcacatgaaatgcacacccgacttggagattatgtatcacgactatgccacgggaaacgtccccatagccgtgatgatttatgtatcgcgcctaaagtaaagctacgaatgttcatagttattcttaaagctaatttgagattattgtaaaaggccttacgttatggaattatttgtggggaagatgtaagatatttggtttaagtgcatattagtgtgtagtgattgtttgaagaatggctgattcattctgactaacttacaacattagatatttaaccaactctaatcttatgcatgtatcttgtttcaatgaaagcgatatatgaacaatagagtgatgatcattgtcagtagcaaacaattatgagtcataaacaattcctccagataccaacacatgagtactacactaatcaacaactattgagtcactgacttttaaaactagcagattatataagtttcatttcagtatgtgacattactcaaaataggtaacaagctaatacaataaagttgctcacatttcatgcaactcggatttaaccaacaatcaagctccaattcaaatttaaccgaattctactcgttgtctgaaattagatatacacaaacaaatgcaaacagtagcagtagatgaactaaacaacaaacgatttcataatcactgttcggaatcagatctaagcaataaagattggtttaggtgacttaattaaaatgtgtagagggagtgcaaattgtactagtattttttaaaagacaatagtgattctaaactcaacaacaaacttttagatttatattcatatggaaaaaataactttaataatacaggaaccaaacaacttcatgatttactaatgaaaacatatctttagaatagttttgcaatgaacatacctatctgcccaaaggctaaatttagaagcaaaagaggccaaatacatgccagaaatcagtaaattggagctcagcttcaacaatattgggacaaaaattagtaactcgaactcaacaacatctataggaattgaggaggagtatttgagctttgaattttcaatgacccgatggacttcaaatcttcatcaaaacattcattttccctttttagagcctttgttttcaaattcgatttttttgaaatttgaagaacctctcttctcttttagatctgtgtatgaacgagatggtgaggagggagaaggcggcagctagctaggttcttttttctaaatggggggggggggggnnnnnnnnnnnnnnnnnnnnnnnnnnnnnnnnnnnnnnnnnnnggggaggtctgatctcttgtgttcagagagagaaatagaggagtccatggaggagggaacgacgctgcttcttcagagagagggggttcttctaatctatatataattaaaagcaggggatagaagcccctcattaagccaagtgtcgcgatactacactgacatgtggcagatttggacaaggctccaacattgtaggaaccaataagaatttgagttaaataaggtatttattgtatttggttgcaaaactttttaatacgtgggttaaaacgtatctgcgagttattgaatttcaatttttccaataacagttactgaacgtgggttaaaactgatttggaaccttaatatttttccaaaactaattccataaaagattgcattaactgaacgtgggaaacaggagcaaaaccgttcacttccattaaattaaacctaatcaaacataaaaactgctgtggcaaaatcggaaaagctcgacggccattgaattggaacgagagagagacgctcgatttagcagtactatttcaaatacagagagacggagggagatagagatagagaatggtgtatataacgtttgtggtcattgttttgttatcagtctcaagcgaattccaacaaaatgacattgatgatataaccactctgtttcttttctttttcctttctggaatttggttcttttgcttacttgcgtcagtattttcatgcaaccaaatactactgctttgccagtttaaaatggcatactgcctgtagtgaccgattaattactattttatccatttgaacaggataagtcttggcgtgttcgttacatggttgcaaatcacattgaatttccatctagggaagaaattgtgttgaaaagggaagaattttgatgctggcaacgtgtttgacgatatgcctaaaacaactagatgtttgaaaattcgttatttcatatcaggagatgaaagagtaattcttcttttccaatacgtgtaattgttggagaaatgagaaagagaaattcttcttttccaatacgtgtaattcttttgcttaatgtcttgattcttagggagatacatttatggtatgtgctacccaatgaagttaaggatgaatcccttatgaacaaatatatggaaattctatccccatgtgagattgaaaaggttttgagctttcaaagagatgatcagctgaggaaaagtgctttgcttgctcgtgttcttgtcagaaccaccattgccagatgtaagatgttatgttgagtttttagtgttcaattgaatttgcccggccatgttcagttgcttaagaagaattgagtacttgaggggttcaactcttaaggtttttagtattaaacccattgtatttttaaagttatgggttctgacctaccatttgttacaatttttaatgacgggtttcaaactctacatctgcccctaagtacttgcaagaagttaattgatagtatgaattgttagaatgttgtgtgcatcaccacctgttttctccatactttcaatttgttgttgttttagttatgttctttttattcgcagtgcacgcaaataatgtgatcgttttggtgtaaccggatcaaactatagatgatgggagagtgaacattgtttcgcattttagttcatgatgttgcaatgtaaatatatctggttagaggatgtataatttggttgagatagagattcagcctgccttccaaaaatgtaactattcagttattctgatggctactagctgtttctttgtgattaattttgaagtgtaaatgtaaatgtttgtcagctgccaatctagaattcaaagaaattggaatgtctttctatttcattgcacttgtactccattgttgttagatttagtattagttgatgttcttttcgctttgtttgcttggtgttagtgcgtgtcttttcatgagccaagggtctatccggaaccgtctctctacagtcaaggtggggtaaggcctgcgtagacactaccctccccagaccccactggtgggattacactaggttttttgttgctgttgttgttgttttccatttcattgcaatatcagattcagttcaattctctataataatttgctcgatcataacttattataccagagtaagagaaattaactgatggctgaaggcatttttttttcctagatcaaataaattcttcagtgacacccaaatccgtcaagtttaggaataatgttcatgggaaaccagaggtttgtctttcaatgagtttccgttggtttgctaatgctttccttctgtattcatggttgtgcacagttaactttatatggatatgttaataggtagattggtcgtgcagttacaattgggagccccctcctttgcatttcaacatctcgcatacttcatctctaatagcctgtggcgtgacaagaaattctcctgtaaacaatcttctgctcgagtcagtttgtgtgcatattcaggtaagtggtagatcacttcttttatttatagattggtgtggatgtggaggaaaagcaaagaactacaaagcacaatattttgaagttggctagaagatatttctccaaacatgaagttgaagtgttgactgctattggagatccctatatccagcaccaagagtttataaggttatggacgttaaaggtaagtctatcttgaggtcttgatatttgtttacaaattgtgtgatagcagcatgattacggttgaatcatgtttaattgtcaacttaattatgacaatcatttcaataagatgtctcaagaaataagaatgtagccatagtaattatctgcatgatgtaaggatgtggcacactcaattataacaatcattgcaataagctatccagattttagcattaagcagatgctgcttgtatacttaaaagccaaagacaaaagcccctccttaagccaagtgtcatcatcagaatatgacacatggtactttaggacaagcctccaaaaaaataggagctataaaattatttgaaaaaataactgctttgaatttgaacagaaacgtaaaagaagacttagaaaccacccactattcccacttcctccattctccttcctcacgatcagttttaaaactaactgctattctccccttgcatattaaattaaaaaaaaaaatgtacagttccttttaactctcaccaaaaactttgttggggaaaattacacccaaaatcattctccgtaatttttcattgttcaattactatgtactttgcttctgaaacattcttacgcatgaccattgacgttcctcgatcttttagtatacgttcatcgtttggaagattaaatgcaattgtttgagggcctttcacatcctgccaaagaaaggaagacactacctaattaagctttggctttcgctttcagtggggaataaaaatcacgcctttgttcttccgaaaagaagaagtttctgaatttggctcaaaggtatttggagttttaaaataaaaagacgaaaataaagaaataaaaactttcagagaaaaatattaaataaagtaatatgctaataaaaatttctattaacaatgtaataatgctaaatattggatgatataataaagaaaaatacataatgaaaaagttatttgttgcgctgcctgtataagtcccgttagtttaatagagattttatttattaaaattttgataatattattaagaacaacagaataaaatttaaaataaaaaatatttcaaaagtaataaattttatatcttctcatatattataaaaagaaagcgaatactaaacattggctaatataataataaaaaatatggaacaaaaaatttattcactaactatataagtacctttgatttaatagagatttcattattgggtatatcgtattgacaaacaagatgacaattcaattttattaaagcaatacgatctaataggatcaaacaagcccaatcataatttaattaatattgaccgcgcatcgcgcgggtacgactactagttttttatgttaaggggaggggagtgttttattgaagagggaagggatgggcctggcgggttatggggcggattgggcgtgggttagggcttctattctgggcaattgggctattgattttgcttatagcctgtttggccaagcttatttttggccaaaagtgcttttttttggccaaaagcacttttggccaaaaattgaggtgtttggccaagcttctggaaggaaaaaaaatgcttttgaggagaagcagaagcagttttggtgaagcagaaaaaagtagcttctctccaaaagcacttttttgaaaagcacttttgagaaaaatacacttagaagtagtattttaaagcttggccaaacacaaattgctgctcagaagtgcttttcaaactaattagccaaacacaaactgcttttcaccaaaagtacttttgagaaaagcacttttgaaaaaaagcacttctcaaaataagctgatttttgcagcttggccaaacgggctattagtctagttagaaatgtcaacaacctaatccttctttaattttaattgctaaatcaatcactttagataaacatctaaataaaaactagattggcaaaattagcctgttatctatcacttaatcaattatttaaccaaaaatacatgtaaaatgactaacatattttttgttgtgatttttcatgtattagttctacaattaataagtaattaatttttaaagtacaaattaaacttaagatggcatgaaattaaaatgtgataaattttatgattttttctaatattaaaaatgcataaaatgcaactaaataaagaaacaaaatcctaaaatcaattaaaattatttttattctatttttaggagttatttccatgtggggcaaaaattaggtgctcacaacttcccctctttgctcgagaacatgaagagatttcgggcaaagataaagtgagcaattacgatcaacttttgtccatttggaagcattttgaaaaagcttgaccgagaagctgtgatttcacttttgttgctgctattactgcttgttgagctccttattacaccaaaatcaaaaatgaaaaagactaactaagtctatcagctacgagttacaagattcctatttatgagtcttttgaagcttgatcttgagtcttggctggttcttcatgcggactctgatctgaatcttgatgcttgttagctgcaaatgctggttcattcttttttagctttttggatcaaggcgagacatgcaaagcttgtgacttcaatcatgttttgagcagtccacgtcttttctccgcttctgcactttgagttcacttcttttttttcttcttttacttttattctggattgagacttcttcttttggacgtctcgaaccctgtgcctcgaggtataacctgctcgggcaccaaaacaaatgaacgaacaaaatctttctaccccagttttcattagaaacatttcgtgagttatttataacaaaactctatgctacttcattattgaaaacaataaaagggcgagaatggtgtatccttgagagaaagagactagggaatagagaccctagatataaaatgaaatcaactagggattggagaccatattgttgaaaaatcatcaactggggggtggtgaccctatgttggcatcaggttatgctggcatcaactagggaatggagaccctatgttggcacaaactagggagtagtgaccctacgttggcatcaggttatgctggcatcaactaaggaatggagactctatattggaaaatcatcaggttatgctgacatcaattagggagtggaaccctatgttggaaagtcatcaggttgtgttggcatcaactagggaatggagaccctatgttggaaagtcatcaggttatgctggtatcaactaggttgtgggaccatatgttggaaagtcatcaagttatgctggtatcaactagggatttgaaccctatgttggaaagtcatcaggttatgttggcatcaagtagggagtagagaccctatgttggcatcaactagggagtggtgaccctatgttggaaagtcttcaggttatgttggcatcaattaggtagtggagaccctttgttggcatcaactagggagtagtgaccctatgttggcatcaggttatgcaggcatcaggatatgctggcatcaactaaggagtggaggccctatgttggcatcaactaaggagtggtgaccctatgttggaaagtcatcaggttatgttggcatcaactagggagtggagaccctatgttggtatcaactagggagtggtgaccctatgttggaatcaggttatgctggaatcaggttatgctggcatcagggtatgttggcattaactagggagtggtgaccctatgttggcatcaactagggagtggtgaccctatgtttgaaaactaatcaggttatgctggcatcaactagggagtgggaccctatgttggaaatattatcaactagggagtgacgaccctatgttggcatccggttatgctggcatcaactagggagtggagaccctatgttggcatcaacttgggagtggtgactctatgttgaaaaaaaaatgcagctagggattgaagaccttatactaaattttcttcttttcattcttttcatttcatttttttcatcattttttatttaagaaaatgagtaaaatgcaggagagaatttggaggagacttctcttttggattgattattgctgcagagctattttagtctataagcgatttccttttgttgcacatgcttcttgcaacgtttcttctgtatagcaccggttttctatttttttcaacaaagaacaatttgtcaatttgaaacggtggttggttttatggccttgattatttcagtcacttgatctcggcccattcaattgcaattggttgtttctcgaataccgattgcattttcgaccctggagaacctctagctttttcaaacattgccttgatggttggtcacatgggattcaacctttctgactttatattgcctttgtaggcctttcacttctgacctcttttttcaatttttaacttcggagcatatggaaactttttaactcctcaaacttgctgcaacggctagtcgcgtgggacttaaccttttccaactttattttgcatttgtaggcctttcatttctggcttctttcttccaacttcaattttagagcatttggggtaccttagcttttaaaacatttgccgaaacggttagccacgtgggacttaaccttttcaacttcatttgcctttacatgcacttcaatttgatttaatccttccaaaagtttttattttgaagcatcatccgccatggccgttcgaggtcgacttgatgcccccgacgaggctgggtgcctttttgcacattagcttgtgtcaaacgaaaccctgtaaatcagttttgccatcgtttctttgtcctagttttgaaacagagttagaccgaaagtgtgatgacccaaaaggtcatcacttgattttcgagtcaattctgtgttctgaggccttaaaagcctccttttatctcacctcgatttgtgtgtgcagtccgggcgtatatccgaaccgcttttatgtgaaaatttgatgagaatactaatttggcctttaaaattgaatttaagttgacttcggtcaatattttgggtaaacggacccgaacctgtgatttgacggtcccggagggttcgtaaaaaatatgggacttgggcctatgcccggaattgaattccgaggtcccaagcccgagaaataaatttttaaagaaaattatttaactgaaattttaagagtttttggagatttaaatgtatttgaaattgatggtatcgggcccatattttgattccggatcacggtacaagtcttatatggtatttagttcgagcctgtaaaatttggtaagaaacatacttgatatgacgttaatcagaccctcggttgttaaaatttgaacttaagagttcttgagattcttctttgattttgatgctaaattcgtcgttaaaggtgttaatttggagatttgatcgcaagagtaagtccatatgacatttttgagttagtatgcatgtttggtttggatccccgagggctcgggtgagtttcggataggtttttacacttagaaaagttacaggttttgctgcttcagtgcacagacattttgtccattgcgatcgcgtagcaagtctcgcgatcacgaaagagaactgcgctggggatggaagagagggactcgaacacggagaactagggggctgctctacgtgaacgcgacccttgtcccgcgaacgcgtagtgtaaaatggagggggctgggaatcgaccttttcttctacgtgaacgcgcacattggtccgcgaacgcgagggccagggggtatacccttcgcgaacacgtggagaatattgcgatcgcgtaagtccttaggagactgctctttgcgatcacgatagtgttcatgcgatcgcgatgaacattgttgcccaactcttttaagcagtagtagaaatgggattaagtcattttatcgcatctccttccccaaaatcagaacctaggcaatttttgaagaccaaaatcaataccaaatcataggtgtatgttcctaaacccatctccttcattttccatcaacacccattagatttctaggcctaaatattattcttccatggtggaatttgggattttgtgtagagttagggctttttgaataattagaatttagacctcgttttggggtcggatttcgaaactaattgcatattcgatctcgtgggtgatcgggtttttgtccgaacctcgagttttgaccaagagggcccggggtcaatttttgactttttggggaatatgatagaaacctataattaagcattgggtatgaattatttagcattcattgatattgttaaattaatttgggctagatacgattgaattggaggccaattctaaaggaaaagcggtgtttgaggcttgagttggccgtggaagttcgaggtaaatatttggtctaaccttagcttgagggaagcggtgtttcaaatagggaattaagacacgtaaacatgctattctaaactaaacaggatgattacatatgctagtgtagctcaaatagagtgaaataggttattaattagtgaaaaatagagttttacaataattatcccgtgtatgcactcgtcacctcacgtacacggtgctcacatataaaaaagtaccaaatcctaaggggagttcccccacacaaggttaggcaagccacttacctcgaaccaagctcaaatatttggtctaaccttagcttgagggaagcggtgtttcaaataggaaattaagacacgtaaacatgctattctaaactaaacaggataattacatatgctagtgtagctcaaatagagtgaaataggttattagttagtgaaaaatagatttttacaataattatcccgtgtatacacttgtcacctcacgtacacggtgctcacatataaaaaagtatcaaatcctaaggggagttcccccacacaaggttaggcaagccacttacctcgaaccaagctcaaatcaatccataacaatgctctttccatgaatatccgactccaaatgacccaaatttagacaagatcaattacatatcatcaatataactacaagaaactaatctagctaatgaaagcaaagctaaagcaggaaattgcaaaatcgttctaaaaggtctcctcgggcccacttctcggagtcgggtaaaagtcacaatatgaacactcattcactcacgagtctaaccatacaagtattactcgaatacgacctcaattcgtcttccaaaactcgaaaataaggcctatgaagtttctaccattttctcccaaatttccatctcaaatccttaattagaagataaaaataacgatagattcatcaaatatggcccaatccgagttagaaccacttaccccaagaatcttcttgaagaaatatcgaaaaatcgcctcacatcgagctctcaactcccaaaatcgaaaatgggaaatcaaccctcgaatcatattttttgcgcagcaaactcgctcttgcgagccttcaaccacgcctgcgggaaatccatcgtaggtgcgaatatcacttatgagggctggatccgcaacagcggcaagggggccgcacctgcgtgtgtaagcctgcagaacactgtccgcttctgcggtccttctccatgcctgtgattccttaggcgcatatgcgggcatcacagctgcggtgcttccctcgcacctgcaatcccaggtcaagcctccaaactacgcacctacacccttcactcctcacgtgcgatcccgcacctgcggtgtccccactgcaggtgtgaaagcaccaaatgtctgaagacttctgcaacaatacaaatccaatggctgatccgttaagcacctgaaactcacccgaggcgtcgggacctcaaccaaacataccaaccaatcctaaaacaccgtacaaacttagtcgagccctcaaatcacatcaaacaacgccataatcacaaatcaccctccaattcaaacttaaaaacttgaaacttcaaatttctacaaccgatgttgaaacctatcaaaccacgtccgaatgatcatgagcaagtgcacaaaccatgatcatgagcaagtgcataaatatactcctgaaagataagtggatataggaagttgtgttgttgcgatctatctggctgtaaatatctttggatttcttccatttgaaattcgatttgaaccaaagatggaagattttgagggttatcaaatgatacatagtgcgatacagttaaaacaaagtattttagtaagaatagataccttggatacaggtaaacttctcaacggattctctatcatctcttttttttttcgtttcgtttaattggtctatgtttaattggtctatgttatagtgttataggataataagatggttagaaatcctttattttttcaacctaatcgctcttttgacttcggaaaaaactttctttatcaatatactgtttcttctacacacacatctccataatagaaaatggtaatagttaggattcattaaaaaaatggagaatccactaatgggacaagaaacccttcccgcatcaggcactaataaatttttaacgtctaattagatcgggaatcattcaaattaagaacaaaagctcgttgctttttctttccctataatttaattgaagccgcagccctatccatttattcattcgacccaactttattttgttccgttccaagaattctaacacggttttatacccatctaggaacaatgaaatattctcagaactttccgttgatacgacatgctatttttaccattcattccccttcaggatcagtcgtggtcttccaaactttaccgagagtatggacgaatccctcacttcatccatatgtgtaaaagagactagccgcacttaaaagccgagtactctaccgttgagttagcaacccgaagaaaatatcgaagaaaaataaataaagagattagacaagacaaccaaaaaccattgaaggaataaatctaaaaaaatacattcacattttcgaattaatttaaaacaaaaaataaaactaaatagatccacttcatttatcacaatgaattatatttgttcgatacactgttgtcaatataaatattgaatagtgaaaaaaaaaaaacaaaagaaatttcaattgacaacaataaaaaatattaaaaaaaagggcttgtgttagattggcactacaaatctaatccaaataaaatagatacaaaaaagtatagatgagagaataaattaagtggaaaacaaaactataatttatttagatttatttaatccataatggattcaatcaagttaagtgagataagcaaacttgatttcttttacacacaagtcatattcaacaatacgaacctactccaacttccgaaatttgaatccaactccgatatcaaaatttccactatcgttccaaatctccaaaaaattaactttcgccatttcaagcctaaatctgatacatacctccaaatcacaattcggacacgcctctaagcccaaaatcacctaacggatataattgaatcgactgaactctatttcagagttgtcttcacacaattctgactatggtccaaattctaagacttaagcctccattagggactaagtgtcctaaaaaacttcaaaaataaaaacgaaacctttcggcaagtcacaatagcagaactgatatgggaaaagcagttaataggggattggggctcaaactctcaaaacgaccggccgggtcgttacatttagttaccaaacaaaacaaattatatatgtttggattggtttggttttatcgggtttttcaaaattttcgggcttttgttatataaatattattttagtcttactttcttaaatttcttataaagaaatatatttagtaaaaatttagaaacggacaaatatattatctattaaatattcttatggaaaattattttagtaacacatgatagttattttttattcgtctgacaataagttttcgttgatgtacactttcaaggttaactgaatttagtaactaaacataaaaatcaatactatacctaaataataataatcacgtcaaattcggaaaagatataagaatttaatagatcttgacatatgaatatggaagaacaaagagattgacgcatttcagtaacacttgataagaaaatgatcatacaacacattacaacaacaacaatgtcacgaccctagttaaccaatcctgaacctgtcatgacggcacctagtcttcacgactaggtaagcctaactcattgcggaattaacaacattatcataaattaaataccaaacgctaaataccataaggaaatgtataaaggtgccacttggcacgtacactttaacacaaaatcgaatcaactcccaaaacccggaatctcacaaatcacaagctagggaaaatacatagggctctgactcaagaatgtttatacaattgaaatactggaaacaattacactattacagaagctggaaagggactcctcggtctgcggatgcagcagacatacctcgaagtctctaccgatacgcctccttccaaggcggacagaactgactgggagtacctgtatctgcacaacaaaaatgtgcagaagagtagcatgagcacaccacggcggtgcccagtaagtatcaagactaacctcgatggagtagtgacgaggaacagtccagacacctaccggtcaattagcagaataatcatgtgaataataaagacgatatatgaaattatgtaaaggctgcatgtatgactaaaagtgctacaaatcacaataaggaaaaaggcaacaagtagcaacgagaatataataaatgatgatacgaacgaaggcagaatcacaatccaaatcctacggtcaccaccaaatttgatacgctcaaattacactataataattagtgtaaggcggtcgatgtcaaatataataacccaacaaggttggggtcgaatcccacaaggaataggtgtgaaacgcttactcgtttagtgtgttgctcactctagtttaatttctattcggttaaaggtaacaagaaaatatggtaacaaaagtatgtatgtttgattgcgtttaagtaacactaaatttaacaatttatgatttaactattggataaaagcaaccaaggttgtgtccccttcaatgtagcgtaatgtcaatgagtgttaataggatttctttctaatggatggtcattaagatatgcaattgatgtctaagacactactcactattttccaataaatgaatagtaattctctttataatttttccaaatataaaaaagtagcaatgaagaacaatcaatacatgccaattaaaacccacttattcctaagcgattttataaaacaagggttaacaccttgagtcattgataattacttcttccaaattctaacccactttcccaagcaaagcaagaatttaatggcttttgttgatgtttgcaaccatcaacaatcaatgaagaatgagaagtaaataaatatcaaccttccattatagagataatcaatggtaaacacccattaacaaaacacccatttagggttcacaaccttagtatttgaacttagctagacatgccaaaatacaaaatcaaaataagatataaactcattaatgcttacaatgagaaaatcttgaatcaaaagcttcaaccttgttatcttgtagtctaagcaatacaaaatgctctcaaaatgaagtagatctcaaaatatcaaaacctagatgcctttacaaatgacccctgaacgtgtattaactgagttgagaatagaaactatgaaattccagatttgcccccgtttgaaacacgttcttcgcaattcccatgtatacttcgcatttgcgaattactctgaaagtcagcttccttcgcatttgcgacatatacatcgcatttgcgaagtctcatacgtttgcactataatcgcaaatgcgatcaattcttcgcatttgcgaagaactccaaatcctgcttagctcgcaaatgcgaacaattcttcgcatttgcgaagactgccctttccttcttggcttcgcaattgcgacctggggctcgcatttgcgaagaaactgccttatgccttgttgtcgcatttgcgacatggacttcgcatttgcgaagtctgaggctgcccaggccttttccctctttttggcttcaatttgcgtcgttttcaattggtttcttcgacatcacgtctaaatcacattcctcctgtaaagtagaagtaattgatattaaatgcctgattttatcactataaacatagcaaaagcatagtttaaaggcaagataagtcggtaaaataccaacttatcaaccacatagcaagaacagcaagttcccaattcatattctacgatgaggcttaaataaggtcttaatcaactcttcccacaatcattaccaacatctcggacaaagcacaactcacgagaaaaacccagcctctgaagtctaacacccggcatcctatgccccataaatctcaaggtcatgctgacaactcactggttatctagggccactctcacatatataatggacacaagagggcataactccacccttagcccaactggaaggacttcacctatattggggtgtccagctacgtgtatgcttgtgcgagtgtgcctaacaaggatcctacaactagtaggtataagaaatggcacgaccatcacccggtatggttgcacaactatagcaattgaagatagaatatacggaaaacaactacaatatataaatagagaaaacaaaccactctcagacatttatcgtcagaaaactcacggtatcccgaggatctctctctggtatcctcatcttaacaagggatctctatagtattcccgaggatcacctagtatcatcaatgtgtatgatagggatctcccggtatcccgaggatctcctagtatcctcaatatgtgctggggatctcctggtatcccgaggatctcctggtatcctcaatatgtgctggggatctcccggtatcccgaggatctcctggtatcctcaatatgtgctggggatctcccggtatcccgcactacagcaccatcaacgtaattatacagtccaaataatatattaccaacctcccgacaagggagtcaacaacagaaagcataatgtcccggcaagggaatcaacaacagaaacaataacgtcccgacaagggaaatcaacaacagaaacaattaatgtcccggcaagggaatcaacaataagaacaacaacgtcccggcaagggaatcaatgataagaacgacaacgtcccggcaagggaatcaataatacataataagaatcatggaaaaaccaagaagcatgataacctcaacaattatcgaaacataacaggtgcatggtagctacattgctaactccaactattgaacacgtatcctatttgcactaagtcacagatgaactaaaaatcgatgagtatctaaacaacaaggaagtgaacatgaaccaaatagttatgattaagggattatcaactaaacataggatatctaacttctttcatttaaggcccatatatttcatgagaagtaaggacaatgatctccaattagaggcaagcagtttggagagataacatagctataataggaataacgttttcagttaaacaaatagaagtcaactaagcagcaggaatagccaaaagggcaaataaattccaagtaagacatgttgaagtgaaactagcaacagggaactcaatcatatcaagaacaacttcatactcagtgatttcaagggtctaagagcctaaaagaatcaatttaccacaaataaatccgagcacacactcgtcacctcgcgtgcaaggaatacaatcaacatagaagactcaaatcctaaggggaagtcccccacacaaagttaggcaagatacttacctcaaaaccggctaaatcaactagcaaccacgttcttgccacgaattctcgactcgaaatggcccaaatctattcaattaaatcacatattgtaaataacatctcaagcaactgattctacaatttaattcaaagctaaagcgcgagattaggtaaaatgaccaaaatgcccctcaggccaatgtctcggaaccggatgaattaatattttcagaactctctcactctcacgagtctaaccatataaagatgtctcaaatcggaggtcaaatactccctcaaaactcaataattcggtctatgaagttctactcattttatattcaaaaactgaaattaaaggatgaaattaagaggagattcatggaagttggtctaaatcaagtgaggaacacttacccaagttgcccaggtgaaaatcccttcaaaaatcgccaaggaccgagctctagaagtcaaaatgtgataaaatggtgaaaccctcgaattgggattaaaattgttctgcccagttaaattgttctatgcgatcgcggagaataggttgcgatcgcatataggagtttgggagggtccaatttttgtgcactgcgttcgcgggaggaaggatgcgaacacggagaaggtcctggcaatgcttcgcgatcgcggaagcactagtgcgatcgcgttgaaggaaataagggggtccagtgttggtctatgcgaacgcggaatccttgatgcgaacgcgaagatgactgaggcagacctatgcgatcgcggaggcctctatgcgatcgcatagaaggcatgacagaagcagcaacagcagtccaaaaagaagaggaaaaaggacccgtagcccatccggaacgcacccgaggcccccgggaccccgtctaaacacacacacaagtcacataacctaacacggactcactcgaagtttcaaaacacataaaacaacatcgaaacgacgaatcaaaccaaaaatcaagctaatgaactttcaaatcttcacataacgaacctcgtgccgaaacctatcaattcaactcggaatgacgccaaattttgcagacatgtccaaaatgacatgacggagctgctccaactctcggaatcgcattccgaccccgattttccaaaagtcaaccgtgggtcaaacttcttcatttccaaacttcaactttcgccgaattgcctcaatttactctacggacctccaaatctaaatccggacgcgcgcctaagtccaaaatcaccataaaaattgactccaaaccatccgaaagccgaattccaccatgcacgcaagtcgatattcatattccgaagttgctccaggccttatgccactgaacggagcttaatttctcaaaacgaccggtcgggtcgttacatcctccccctcttaaaaccaacgttcgtcctcgaacgtgctaagattcacctcgaagtcctcaagtcactgattgcgcacttccaacatacacccgcgggtgatcccacatcacccaatcccctccaagcatgacgacaccatcttaactgaaattttgcccttctagcaataccaataagccttcaagccgaaaattttcaccttccatccagtgtcaaaagacccgattataaatccatatccggtatcagtctcaaccagctatttcaatacaagccaacacacacagggtaccgccacacaacatgacacaccacgcataggaccacggtgatatttctgatggcaatacttgcctgagatcaaatttgcactggccttaagcctcatgttcagcagaaactcttttcccaacctccacaacactggcgatgatacaataaccatgaaaatcacatagcaaaatacccgaataaccaagtctcagccagcaccatcgggtgcacatcccacaactaaaactcaagaagcatcgaatggagatgaataaatatgggaaatgaaaacacataagggaactaacaaacaacctaacaagcacaaattcttctaaaacacaaatctacaacgacatctagaaaaaaggaacgaaagcatataaaagactcacgaggaccttatactgatataactctcaccgcggcacacagcccggtctcaacatgtcaaaacacctgaaatcacgagggttccgccctcaatctctgaatcacaagtagggctcatactaacccatctagaaactctcactagatcaatctcgtctacaattacaacacagactgactcccacaccggtggagcatagaaatcacagctcgtaagcaaaatactcaagagtggcatcaaatctatcaaacaaacaatatgaatttactactagcctcgtaacctccggcaatagctagaaacagacgatagacgcggctatcactcatagaatcccccaacaggataatcacataaacagagtgcaaatcatgaagcactcccataaatggaacaacaaccaaggaactcaacatgataagaagaattgtgatgaaccgcagatagtgcctctttataacaaccgaattggcaactgaatgactttacatggcacaccggcctcaagcctactatatgaagcacatcaacgagtcgggcctccccctcttaggcgccctctacctgcctgaattaccttgctgcgacacatcggtccgaagtctgagacaatccctcaccatgtggctaatacctccatactcgaggcaccctctccgctgacgaggcggtgggaactgtgcgatacgggtactctgagacccatgaacacctaaatcaccatgcaaggcctgaaacgcgaactaaactggttgatccgaaaaatctctaccatgacgtaccctgcctccaaaacaatgaccagtatatctcaccggtctacgaggccgcctcgcctcctcaagatatctttccttatctcgtctactttctttcttatgatcctgcctgctctctctctctctctctagcatgcataccctctatcctccaagcaatgtttatcacctgccgatacggaatgctcatttataactcacgagccatactggatctaatgctgggaatatgtccctcaataaaccgacgaaccttctcatgaacggtagaaaccaaagctgaggcatgcctagccaaactgggtaaggacaacatactccgagacggtcataacactctggcgcaattgctcaaactccacgcgccatgcatccctgaggctctaaggagcaactctcgcagaaacatatctgagaactgggtccaagtcagtgaagctgccccctctgggctgtctaactcatagatgcgccaccaatcataggcggctcctcgaagctggaaattagtagaagaaatcctgctcgatacggaaacacccatcatacgaagaatacggtaactcccatcaaggaatcccaaagcactgtctgatgctaatccactgatcaccggaatttcatacttctcgaacctctctagtcacctccacttatactcagaagccgctaacatgccctcgggctgaactgatgctgcaggcggcgtaggaaaaatctcagggacttgctcaacatgcgctcgctgctcaggagtgcgggcggcgggagtctgtgctcctcccccggtctgggtgtgactgcagcaagggaaagcaatcctgtctgagccaaggtagtgtacatactcatgaactgtgccaaagtctcctgaaggctagcgtagtagtagctgtaggcgtgtcggtgcctggactccggctggttctgctggtgatacctcagtggcagctcgcgcaggtgctcttgctgcaccacgtgcgcgtcttcgagctctaccctggccccgacctccagcggctgcagcaaggggcgcgggtgtctgatcaccttgattagtacgtgtcctcaccatcggtgagagagtggaaggcagaggattagaattgtcaatgtcaaaatctcgcacgacagggaaatcaaatgaagtggaattttcctaacagttacatagcctctcgcggataagtatagacgtctctgtaccgatccacgagactctaataaaccggcttgtgatctgtgactcctatgaacctagagctctgataccaacttgtcacgaccatagttcaccaatcgtgaacctgtcatgacgacacctagtcttcacgactaggtaagcctaactcattgcggaattaacaacattatcataaattaaataccaaacgctaaataccataagaaaatgtataaaggtgccacttggcacgtacactttaacacaaaaccgaatcaactcccaaaacccggaatctcacaaatcacaagctagggaaaatacatagggctcttactcaagaatgtctatacaattgaaatactggaaataattacactattacagaagctggaaagggactcctcggtctgcggacgcagcagacatacctcgaagtctctaccgatacgcctccttccaaggcggacagaactgactgggagtacctgtatctgcacaacaaaaatgtgcataagagtagcatgagcacaccacggcggtgcccagtaagtatcaagactaaccttgacggagtagtgatgaagaacagtcaagacacctaccggtcgataagcagaataatcatatgaataatatagacgatatatgaaattatgtaaaggctgcatatatgactaaaagtgctacaaatcacaataaggaaaaaggcaacaagtaggaacgagaatataataaatgatgatacgaacgaaggtagaatcacaatccaaatcctacggtcaccacatagcaagaacagcaagttcgcaattcatattctacgatgaggcttaaataaggtcttaatcaactcttcccacaatcattaccaacatctcggacaaagcacaactcacgagaaaaacccagcctctgaagtttaacacctggcatcctatgccccataaatctcacggtcatgctgacaactcactggttatctagggctactctcacatatataatggacacatgagggcataactccacccttagcccaactggaaggacttcacctataatggggtggccagctacgtgtatgcttgtgcgagtgtgtctaacaaggatcctacaactagtaggtataagaaatggcacgaccatcacccggtatggttgcaaaactatagcaattgaagatagaatatacggaaaacaactacaatctataaatagagaaaacaaaccactctcagacatttatcgtcagaaaactcacggtatcccgaggatctctctctggtatcctcatcttaacaagggatctctatagtattcccgaggatcacctagtatcctcaatgtgtatgatagggatctcccggtatcccgaggatctcctagtatccttaatatgtgctggggaactcctggtatcccgaggatttcctggtatcctcaatatgtgctggggatctcccggtatcccgaggatctccttgtatcctcaatatatgctggggatctcccggtatcccgcactacagcaccatcaacgtaattgtacagtccaaataatatattagcaacctcccgacaagggagtcaacagcataaagcataatgtcccggcaagggaatcaacaacagaaacaataacgtcccgacaagggaaatcaacaacagaaacaattaacgtcccggcaagggaatcaacaataagaacaacaacatcccggcaagggaatcaatgataagaacgacaacgtcccggcaagggaatcaataatacataagaagaatcatggaaaaaccaagaagcatgataacctcaacaattatcgaaacataacaggtgcatggtagctacattgctaactccaactattgaacatgtatcctatttgcactaagtcacagatgaactaaaaatcgatgagtatctaaacaacaaggaagtgaacatgaaccaaatagttatgattaagggattatcaactaaacataggatatctaacttctttcatttaaggcccatatatttcatgagaagtaaggacaatgatctccaattagaggcaagcagtttggagagataacatagctataataggaataacgttttcagttaaacaaatagaagtcaactaagcagcaggaatagccaaaagggcaaataaattccaagtaagacatgttgaagtgaaactagcaacagggaactcaatcatatcaagaacaacttcatactcagtgatttcaagggtctaagagcctaaaagaatcaatttaccataaataaatccgagcacacactcgtcacctcgcgtgcaaggaatacaatcaacatagaagactcaaatcctaaggggaagtccccgacacaaggttaggcaagatatttacctcaaaaccggctaaatcaactagcaaccacgttcttgccacgaattctcgactccaaatggcccaaatctattcaattaaatcacatattgtaaataacatctcaagcaactgattctacaatttaattcaaagctaaagcgcgagattaggtaaaatgaccaaaatgcccctcaggccaacgtctcggaaccgggtgaatttaacattttcagaactctctcactctcaagagtctaaccatataaagatgtctcaaatcggaggtcaaatactccctcaaaactcaataattcggtctatgaagttctacccattttatattcaaaaactgaaattaaaggatggaattaagaggagattcatggaagttggtctaaataaagtgaggaacacttacccaagttgcccaggtgaaaatcccttcaaaaatcgccaaggaccgagctctagaagtcaaaatgtgataaaatggtgaaaccctcgaattgggattaaaatttttctgcccagttaaattgttctatgcgatcgcggagaataggttgcgatcgcatagaggagtttgggagggtccaatttttgtgcactgcgttcgcgggaggaaggatgcgaacgcggagaaggtcctggcaatgcttcgcgatcgcggaagcactagtgcgatcgcgttgaaggaaataagggggtccagtgttggtctatgcgaacgcggaatccttgatgcgaacgcgaagatgactaaggtagacctatgcgatcgcggaggcctctatgcgatcgcatagaaggcatgacagaagcagcaacagcagtccaaaaagaagaggaaaaaggacccgtagcccatccagaacgcacccgaggcccccgggaccccgtctaaatacacacacaagtcacataacctaatacggactcgctcgaagtttcaaaacacataaaacaacatcgaaacgacgaatcaaaccaaaaatcaagctaatgaactttcaaatcttcacataacgaacctcgtgccgaaacctatcaattcaactcggaatgaggccaaattttgcagacaagtccaaaatgacatgacggagctgctccaactctcggaatcgcattccgaccccgatttcccaaaagtcaaccgtgggtcaaactttttcatttccaaacttcaactttcgccgaattgcctcaatttactctacggacctccaaatctaaatccggacgcgcgcctaagtccaaaatcaccatacgaagctgttgagatcatccacgacccattccggagtcgtttacacaaaagtccaattccggtcaacttttcaccgttttaactaccaaaataaggtttcttccttaaaattgactccaaaccatccgaaagccgaattccaccatgcacgcaagtcgatattcatattccgaagttgctccaggccttatgccactgaacggagcttaatttctcaaaatgaccggtcgggtcgttacaaacaacaaacccagtttgatcccaacaagtggggtctggggagggtagtctgtacgcagaccttacccctacctaatttaggtagagaggctgtttccaatataccctcagttcaagaagaagaggaaaacaagggaggaagaaagatggaagataaaaatgaaaatagaaaagaagaagaaaagtggcaccaaatgatagcaacaaggaatacaatacctgagtcgaacaaaaccaaaacatactaaaaatctaagaatataaagggacatgcatactactaagactatcggtgaacaactataaactaccaactaaccttctaccttaatcctcgacctccacactctcctatcaagggtcatgtcctcagtgagctaaagcagcgccatgtcctgcctaatcacctctccccaatactttttaggcctaccttgacctcttctcaaactctccatggccaacctctcacacctcctaactggagcatcaattcctcttctcttaacatgtccaaaccatctcagcctctactcccgcatcttgtcctccacggagtctactcccactctgtcccggatatcttcattcctaatcctatctctcctagtacacccacacatccatctcaacatcctcatctctgctactctcatcttctgcacgtgggagttcttgactggccaacactcagccccatacaacatagccggtcgaaccaccactctataaaacttacccttaagtcttagtggcacattcctatcacacaaaacaccggaagcgagcctccacttcatccatcctactccaatgggatgcgcgacatcttcgtcaatctccccgttaccctggataatagacccgagatacttaaaactcgctctcttggggataacttgagcatcaagcttaacctctatgtctgcatcatgggtcctgtcactgaacttgaactccaagtattccgtcttggttctactaagtttgaaacctttagactccaaggtctgtctccaaacctccaacctagcattaactccgctacgagtctcgtcaatcaacactatatcatcggcaaatagcatgcaccaaggcacctccccttggatgtgacgcgataatacatccatcgccaaggcaaataaaaacgggctaagagccgatccctggtgcaaccccatcaccacagggaaatgctccgagtcaccacctccagtccttacccgagtcttagcattatcatacatatccttaatcacactaatgtacgctaccggaacaccgctaaccttcaaacacctccacaggacctccctcggaactttatcgtatgctttctcaaggtcaataaacaccatatgcaaatccttcttcttttccctgtactgctccactagtctccttaccagatgaatcgcttccgtagtcgaacgccccggcatgaatccaaactgattctcggaaatagacacgcacctcctcaccctggcctcttccaccctctcccaaaccttcatagtgtgactcaacagcttgatacccctgtaattattgtaattttggatatcacccttgttcttgtaaagcggaaccatcgtactccacctccattcttcgggcatcttctttgtcttaaaaataacattaaacagcccagtgagccactccaaacctgcccgccccgcgctcttccagaattccaccggaatttcgtctggccccgtcgctctgcccctgcacatcttatgcatcgccccttccacctcctctaccgtaatcctcctacagtccccagactcctgccgactctcggagtgctccaactcacccagcacaatgcgtctatccccctcctcattcaacagtttatggaacacgtcatattttattaaatattacatcccttaagagaatcctgaatatttctagacatcttttttatagaaaattgtaaataaaatattaaaagtatatatataaattatatatttatatatcagtttggttcgaatttttttactcaatacccaaccaaataaaaccaaacctagtgggattttttaattggtttggtttaactttttagtttggtgcgatttttcggttcgatttgtacatccccaataactagggttgttttattcatatttactgtcttttctgtttagtgccttagacttcaggtcagtaatgttctgtgtacatgaatcttattcaagaatattgaaattagttaatcatttattcatataaagtgttttgttttcttcttatatatccaagatgagcattttacttaaatccttgctgcaatatatcttttgtaacgactagtaatacatatgtactatgtctttttcaatataaacaaaaatatatataataaaatatgttatgttaagtaatagcataagagggtgacacctggaaccaagcagatgatagctaagaccgaagacaaccgttttatttgttgcaggaaggaatgatgttcataaagatgcaataaatatctgccacccgacagcatttagtgtaaaatattctacagtatttagtacactacccgttacaaataatttatcattcatgctcatcgttacacattcttcaatggctcttataattgacattaaagaagggcagaatcctatgaccttgctccctaggtccaactatacatagtgggctctgttatcattgtagagggagcattttctgacaaacttaattattctataatctattcaaatcttaatacacttttatagtcttgctttttgatttcataactgttgtgcctggaagccctactctctgaattattgtttctgtcgtttcatcttcatctcgctgttgatacccaatttttccatatatatttttcaatatacaaaataccttcaaaatggcataaatatgcatatataagtatgtccaaatattttattattttttcataatttttaaggatttttaaatcaatttatttctctcttttatccataaaaccccaataattatttccaaattattattttgggtaattcatttgttgggcttttatatttatgctaaaatatagctaatgtaatttttgcatatttttacaaatttatttaatagtttaagctaaattatatataattgtaatattagtctttttgtgatttaattgtattttatattcataaaattaagtctagtatttttaaattgttaattatacattataagtcatttcagtgctttcaatttgtttccagaaattaatttactaattttataattttaaaaggggaaaattggctatttaaataatagcccaattgcattttaattgtagcctaaatatgaccccacattaaactcaatttccccgacccaattcccattcaaacccgaaccctaacccaattaaacgatccaacccggattccccacctacccttttgaatccagatcgttgatcactcagatcaacggccaccattcgcccttccataattaaacccaaaagaacccttaccctacttcattattcaccaaacgccgcctcggaatcccctcatctctcaattctatctgaaacctcacatgaaccctacccgccgccatctcattccaccctaatccgccttaacccctgccttatccatggcctctcgtggccattggagatgtgtatcagcctcctatatctccttgggtgtttgtttctgtggtttcatggccatacctcgaagggatctggtccagttcttgctcgacttctgttcatggcctttctccggccatccatgacctttctccggccattcatggcctttcaaggtaggtccttgactttcctagttagatcggtaactttcgaggtctttctcaccttttttgggttttccgaaaccctaatatttaatgtctttcaattttctttcagatctaccttagatctgtacttactatgaatttcctaagtgctttctcgaaggttcttcaacttttctttcaaaatgactattcattttttccgattagggtttctcttaacctctctcttaaagatctcttctctgattttggtgttgtttcatgattttgctatgttacctgtttatgctttctttctacttgagtcagcatgtttaaaaccctagttctgaagttatttgcttaaatgtgtgcttatcttgttctttgtttctgactctcttttccttgtttgacttttttgattttgagttcttatcatctttaaaaactcgactactatcgaagccctaatttcttaaaaggttttcctcactcgatactatgagacatttacttgtttctgattctctttacttgtttctatgttttcttcactgttgattctatgtgactaattcacctacttgactactgtgcttcgaatattttccttactgttgaatcctagcttatttcttccactactgtatgtttgtgttatcactttttgccaatatgcttggcctcgcatgttttatgcttctttacactctatttatatactgaagtgcaaaatcatgtttcttccttgattgatcttgatctggtgacagattgcgaaaacttttcttttaagaaccctaatttcacttgcttatttaaattaattgattccttcctttactctgatgtcttgccttgctgaaccctttcccaaaataagcctattttgtacttagacttgattgtttacttcgtacttttactaccccttatatggcaacaatcaatctgtccccaaacttattttatttccttaattaaacctgctactacccgttaaactgtgattccttaattaaagggaatcacttgtgttaattgattctgattacgattatttccatgtttgtgtttactttacctcttcttcactcgttttcaaaactataaatacccacctcctcttctttcaaggacacgaacatctgagttcagaatacacacttcactcaaaactctctctttctctataactacttgtgccattgctttgtctagccggctgaaagccaaggctaggctatggaaatttgcttacttttcctttatgcactttgcttctttactggtatgtcctagttaattttcaagcatcaacgaaaacctgtttctttaattgttccaacttctctcatgcttttctacttttgcttatgtttctacaatcaggttacattgctagtatgttgaaatgtgttccattcccctttaaattaatgctctcacatgtgtatgaatcccaaaacccatgtcccctctatatgtttgtgttctctggctggtttatgggcatgctagcatcatctattgctgtgcatgaccaaacttgacccatcatagcggtcccgggccaaatgatcccgggcttaacggtcctggagggtggaaccggcccactgtgggcctaagcccacatggtcccgggctaaacggggcgggcccacgggcataagtattctggggtattttttttgatattttttttatctaaggcaatttcttgtaaattatattatataattgtgacttaaatcttccaattcaaatttaaacacaaaaaaattgtaaagaaatattcaagaaaataccttataatttttattattacgacattaactaaaaatggcaatatctttcttagttttcctccccccaatggaatgagcacaacaaggtgctaataccaccattaaaaggaaaaaaactaatgaagatgtgccaaaatacaagttacatattagtctacgtattatctctaacaaatttcataaatccttcaaggtccgaaggaatttccattggtggtggcagaaaagaagcttgttcatcactgcttttgggcgaagcagcatcctccgcaagttccgctagtatttcttcataagcttcatctatttccggttgtgattcagcaagtccaaaatttcttctttccgaacggatccaatctctgaagagtatgctgactgaaagcgctctctgatagacgctgtatgatcaccgatttaaagtctcgcttgactgaaagcgctctctgatgccactgttgaagcttgaatacttaaaatatctcgagccatccttgaaagaaccggatagtatttttctttgtccttccaccattccaaaacatcaaaggagccgtcgagattctctgattcaagtccctgcgacaaataaacttgaatctcatttagttgtaaactatcaccaatattatcaccttgagaacccctgaactccgtccaagaaataagtgcttttaggcccgcagttcttttagatgattgcgaactagacgaagtaggagttggaacatttggtatagcataatctaaagcaagttgataaacattataaattgtttgagcatttattttaattaaggcttttgcatctgcaagtgtagcaaattcctcatctaaaagtgataaagccttataaatatttatataccaaaagtgaggacctcctaatttcatggtaggatttaatatggcagcaacaccaaaaataggggggatagggaaaaagtattctttaaacttatctttcatagaatcaatagcaagttgataaattaccccaccctctgaaaattgagtaaacaaatctgctgtcacgaccccaaacccggtcgcgatggcgcccggccgtaaggctaggcaagcccgaccacaatctagttgtcacgaccccaaacccgatcgcgatggcgcccggccgtaaggctaggcaagcccgaccacaatctcaataatcccagataaagacaataaagaaataatagtctcaacacgaaagagatttatatcccaaaagacagagcggaattgtaatgacccgtcccgtcatttcttatatttcagcccgttatccccgtcatatgtttccccgagtgatgtcatgtttggattggtttttggatagaaataggttgaggagtctatttaagagaaacttgaattggtaaggttgaccaaaagttgacttatgggttagagggctcggaacggatttccgatggctcgactagtttcgggggttgatttgtgacttgttggcggaagcggaagtgaattcggagttcgggagtgaaagttatctaagtttgccgaagttggaatcttggaagaatccggttgataggtgagaatttgatccgggggtcggaatggaattccgacagttgcattagctccgttaggtgatttcgggcttgtatgcaaatttttagataattcggagatgtctaagtcgggtttttgatcgggtttgcatttttaaagtttaagttcattttgaatcgaatccattgaattttgatgatttttggtgtttaaggtagcgtttttaaggcccgagcaagtttgaatgatgttataggttgagtatgtgttgctggttgaggtcccgagggcctcggggtgaaatcggatggttaatcggagcatttttggttttaaagcagaaaaaggaaaatctgtttctggtgtttccgcaggagcggaatttcggccgcgtaggcgggtccgctggggcggacttttagccgctggagcggaaatggttccgcaggagcggaaccgctgaagcggaagaatgaccgcaacagcggtctctgagattttgaaggaaagccgctggagcggaattttggtcgcctatgcgagaccgctggagcggaaaaatgtccgcaggagcggaaatcgctgggaatttatatttccagagtgtttgaaacactcatttagagaagagaaaagaggagctcggactaaggcatttttgggcgattgtggagagattattgaggagattcatcaggtatgatcctatggacttatattaggtgattatgctgttaaatcatggcttaaacacttagaaatcaaggtcttggaagctaaaaatggaggttagggcttgaaacccaactagactttaattgatgatttgagggagcaattagactccgattttgatgaattttatatgtatggactcgtagcgaggcgagggtcgttttggtgtaaagttttctggttttcgaggtgtgggcccggggctcggtttttgctattttcgcgatttgtgttgtttttcgagttctttcgattgggttatgtccccttagcattatgtaacctattcgttgtggttttggccagattcgacgctcgtagaggcggatttgaggcggaagggcatttcgggctagtctacggccggctagaggtgagtaatgctagtaaatgctgttctgagggttcgaaaccccggacttccacatcgtaacgctatatcgaggcgtgactcgcactcctggacaggtgcggagtcggatgttgatggggattgcgacttggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccacgagtccatacatataaaattcatcaaaatcggagtctaattgctccctcaaatcatcaattaaagtctagttgggtttcaagccctaacctccatttttagcttccaagaccttgatttctaagtgtttaagccatgatttaacagcataatcacctaatataagtccataggatcatacctgatgaatctcctcaataatctctccacaatcgcccaaaaatgccttagtccgagctcctcttttctcttctctaaatgagtgtttcaaacactctggaaatataaattcccagcgatttccgctcctgcggacatttttccgctccagcggtctcgcataggcgaccaaaattccgctccagcggctttccttcaaaatctcagagaccgctgttgcggtcattcttccgcttcagcggttccgctcctgaggaaccatttccgctccagcgattcccgtccgctccagcggctaaaagtccgccccagcggacccgcctacgcggccgaaatttcgctcctgcggaaacaccagaaacagattttcctttttctgctttaaaaccaaaaatgctccgattaaccatccgatttcaccccgaggccctcgggacctcaaccagcaacacatactcaacctataacatcattcaaacttgctcgggccttaaaaacgctaccttaaacaccaaaaatcatcaaaattcaatggattcgattcaaaatgaacttaaactttgaaaatgcaaacctgatcaaaaacccgacttagacatctccgaattatctaaaaatttgcatacaagcccgaaatcacctaacggagctaatgcaactgtcggaattccattccgacccccggatcaaattctcacctatcaaccggattcttccaagattccaacttcggcaaacttagataactttcactcccgaactccgaattcacttccgcttccgccaacaagtcacaaatcaacccccgaaactagtcgagccatcggaaatccgttccgagccctctaacccataagtcaacttttggtcaaccttaccaattcaagtttctcttaaatagactcctcaacctatttctatccaaaaacctatccaaaccattcccgactccccgaatacacatgacatcacgcgggaaaacatatgacggggataacgggctgaaatataagaaatgacgggacgggtcattacatcctccccaactaaaacaaacgctcgtcctcgagcgggtcaagaaacatacctggatcaatgaaaaaatgaggatatctgttccgcatctcctactcggtctcccaagtagcctcctccacaggacgacctcgccactgaaccttcactgaggctatatccttagatctcaacttgcgaacctgacgacccaaaatggcaactggctccacatcataagtcaaatcatcatctagctgaatcgagctgaagtccaacacatgggacggatcctccacatacttccggagcatagagacatgaaacaccggatgaacacccgataacctgggcggcaaagcaagctgataggccacctccccaatcttgtcaagaatctcaaaagggcctatatatcgaggactcaactttcctctcttcccaaatctcttaacgcctttcataggcgaaaccttcagcaggaccttctcgccaatcatgaatgatagatctcgaactctccaatctgcataactcttctgacgtgactgagctgtacgatgtcgctcctgaatcaccttcaccttttccaaagcatcctgaaccacctctgtacccaataatctagcctcgccgggctcgaaccaaccaaccggagatctacactgtctcccatacaaagcctcatacggcgccatctggatactggactgatagctgttattataagcaaactctgcaaggggaaagaattcctcccaagagccaccaaagtcaatcacacaagcacgcaacatatcctccaatatctgaatcgtgcgctcggactgcccgtccgtctgagggtggaatgttgaactcaaatgcacctgggtacccatctctcgatgaaaagccttccaaaactgagaagtgaactggggacctctgtctgatataatagaaactggaacaccatgcaatcgaacaatctcacgaatgaaaatctctgccagctgctgcgaggaatatgtagtacacaccggaatgaaatgagcggacttggtcaatcgatccacgatgacccaaatcgaatcaaacttcctcgctgtccgaggaaaaccggtcacaaaatccgtcgtgattctttcccatttccactcaggaataaccatctgctgtaataaaccaccaggtcgctggtgctcggacttcacctgctgacaattaagacaccgagctacatgacctaatatatccttcttcataccttcccaccaatatatctacctcaagtcctggtacatcttcgcgacccccggatggatggagtatcgcgagctgtgagcctctgccaatatcatctctcgaatcccatctacatcgggcacgcagatacggccctgcatcctcagaacaccatcaccatcaatagtcatatccttggcatcgcccctctgaactcgatctctaagaacctgcaaatgcctatcatgatactggaactctgtgatccggtcatataatgaagactgggagaccacgctagccaatacccggctaggctccgaaatatccaaccgaaccatccgattggctaaagcctgaacatcaagagcaaggggtctctccccaactggaatgaacgccaaactgcccatactaaccgccttccgactcaaggcatcggccactacattggccttacccgggtgatacaaaatggtaatatcataatctttgagcaactcaagccacctccgctgtctcaaattcaaatctttctgcttaaacaagtgctgaaggctgcgatgatccgtatacacctcacatgatacaccatagaggtagtgcctccaaatcttcaaagcatgcacaatcgctgccaactctaagtcatgaacagggtagttcttctcatgcggcttcaactgccgagaagcataagcaatcactctaccctcctgcataagaacacagccaataccaatcctcgaagcatcgcaatataccgtataagaacctgaagctgctggcaatactaacactggagctgtagtcaaagctgacttgagcttctgaaagctctcttcacactcatcagaccaaacaaatggagcattcttctgcgtcaatttagtcaatggcgacgtaatagatgaaaaaccctcaacaaacctgcggtaataacccgccaaaccaaggaaactccgaatctcagtggccgaagacggtctaggccaactctgcaccgcctccaccttcttcggatctaccagaatcccatcactggacaccacgtgccccaagaatgccacagaactaagccagaactcacacttggagaacttagcataaagcttctcctctctcagcctctgcagaacaaccctcaagtgttgcgcgtgctcctcctggctacgcgagtacaccaggatgtcatcaataaacacaatcacaaatgaatccaaatacggctgaaatacactattcatcaagtgcatgaatgcagctggggcatttgtcagcccaaacgacatgaccaggaactcataatgcccatatctcgtcctgaaagctgtcttcaaaatatcagaatcccgaatcttcagctgatgatagccagaacgaagatcaatcttggagaaaaccttagctccctggagctgatcaaacaaatcctcaatgcgaggcaatggatacttgttcttcacggtcactctattcaactgcctgtagtcaatgcacattctcattgtgccatctttcttcttcacaaacgacaccggtgcaccccacggtgacacactaggacgaataaaccccttttctaggagttcctgaagctgatctttcaactccttaagctctgcaggtgccatacgataaggtggaatagaaatgggctgagtgcccggcaccaagtcaatcccaaaatcaatgtccctgtccggcggcatgcccggcaggtcagctggaaacacatcagggaagtccctcaccacggggactgaatcaagactaggggtctcagctcccacatctctaacaaaagccaagtacgataaacaacctttccctaccatccgctgggcctttaggaaagaaatcaccctgctgggtacataatcagtcacaccccgccactcaactcggggaaaaccaggaatagccaaggtaactgtcttagcatgacagtctaagagagcatgacacggggacaaccagtccatacccaagatcacatcgaaatccaccatgtctaataataataggtcaacacgggtctccagacccccaaacataatcaaacaggatcgatatacatgatccacaacaaccgtatcccccaccggggtagatacatgcacaggtgagacaagaatatcacgaaccacacccagatgatgggcgaaataacaagacacataagagtaggtggatcccggatcaaataaaacagaagcatctcggtgacaaaccggaataatacctgtgataatagcatcagatgcaatggcgtcggctctgtccggaatagcataaaacctggcctggccaccgtcagagcggcctctacctctgggtcgtcctctacctgcctgaccaccttccctagctgactgaggggaagcagatgaaactggtgtagaagatgagggctggtccctctgctgagatctactaccctgaagtctgggacaaaacctcttcacgtggccaaactcgccacactcaaagcaactgcctggggctggagaaggggactgaagggaacccctcgcaccagaatgacccgccgatctactcggcgctgaagaaccctgagctgatggagcataagaggaaccctgtgcaggaagtgcactcaatgaagactgaccctgctgtgaaccctgatgaccacggcctgaagacgccccgcgatactcgggacgggccggctgctgctgcctgaaatggcgacctctgccctgctggaactggcccctagacggagctccactgaaaccacctgatccacgaggcctcttggcctctctctcctctctctccaaacgacaatctgtctcaatgtctctagcaatgtcaacagcatcctcaaaggtatggctcagaaccctctctctggacatcaaaatacgaataggataaataagcccgtccacaaatctcctgatccgcacccggtcagtcggaaccatccatggtgcatgacgagccaactcagaaaatctcatctcatactgtgacacagtcatatcaccctgccgaaggtactcaaactgcctacgcagctcctcccgctgagaatgtggcatccacttctccaaaaagagagtggagaactctaaccaagataaaggtgctgctcctgccggcctacgccgctcatatgcctcccaccaggtgaatgctgcacccgaaaactgaaaggtggtgaatgatacaccactactctccaaaatacctgcagtctggagcatacgtcgactcttgtcgagaaatccttgggcatcctcgccctgagccccactgaaagtcggaggcgaaagtctgctgtacctctcgagacgacgctgctcgtcctctggcatagccggaaccataactccctgaaccggaacaacctgtggcgctggagcaataggggctgcctcaggggtctgcaagccctgagcaacctgctctggagtctgagcagcaggggtctgatgtcctcccccggtctgagatgctgctgctgctgtagaagctgatacgacctgagctaggccggtgcaaactgacagtatctgggccagggtctcctgaagacccggaatgacaaagggcacggcctgtgcctgagctggtgctgcgggactctcctccgctgatgcctgatcctgaacctaggtagccggtggatcaataggtgctgccgctgtggctctgcctcgaccacgcccacgaccgcgtccacggcctctggcaggtggtactggtggtcgtccggcacctctggtagcacgtgttctcgccatctgcgagagaatagaataatagaatttagttttcagatcaatcagatcgcacgacagaatttcaagaatgtgaagtgtttcctaacagttctgtagcctcccgtggatatgatacggacgtctacgcaccgatccacaagactctactaaaccggctcatgactcgtgagaccaagtaacctaggctctgataccaagttgtcacgaccccaatcccgatcgcgatggcgcccggccgtaaggctaggcaagcctgaccaaaataccaatatttcccggaacaacagaattaaagtaacaaaacttaagaaggaagagaattcaaatactaaaaccacggaaatcaaaatatcccacaaaccaccgaggagccggtgtcacaagtttgagcctctaaagtaaaatattaatccgatacaaccgttcgaaaactgaaagtgtaataacaaggaaaagtaagatagagggagggtcgatggctgcgaacgccgtgcagctacctcaactctccgaagctggatcctgaagactccggaagctagcccgcctgagtatgccctggatctgcacacatggtgcagggagtaatgtgagtactccgacccagtgagtaataacagtaaataaagtctgaaggaagaaaccacagatatgcacaaggtaaagctaagaacagtatatatgacaatgactgaaaccaagtaaagatgcacaataagtaagatgcaatgcagaaatgctatgcaatgcaatgccggtactctccggtacccatcatttatcgtcgacggcgctcactgggggtgtatacagactccggaggggctcctacagcccaagcgcaataatcagccatctcgtggtggcaaaatacgacacagtgtccatgttaccactggtccaaacaataacccggtcagcccatgttaccctgaccgctcatacgacacagtgtccgtgttaccactggtccaaacaccgctacggcacgcagccgagccaaccaatatcagtccagaaaatatcacaagccacttgggcagttataaatcatgatcctcagccagaatacattttaaaagatatcaagtgagtttgaacattgaaatacggctgggtttttgaaaacaatgctttaagaagccatggactgatatgaatgatatgcaatcatgataaacaataatatcatctctcgaagagtatcacaggtcggcactaggccccaaacacggcatatagccccatattaatcacaacagtacgcgtatcatacgccaatatagtatagaataacacacgggatggaccaagtcgcaatccccatcaacatccgactccgcacctgtccaggagtgcgagtcacgcctcgatatagcgttacgatgtggaagtccggggtttcaaaccctcagaacagcatttacaatcattactcacctctagccggccgtagactagctcgaaatgccctttcgcctcaaatccgcctctacgagcgtcgaatctggccaaaaccacaacgaatatgttacataatgctaaggggacataacccaatcgaaagaactcgaaagacaactcaaatcgcgaaaatagcaaaacccgagccccgggcccacgtctcgaaaaccagaaaactttacaccaaaacgaccctcgtctcgccacgagtccatacatataaaattcatcaaaatcggagtctaattgctccctcaaatcatcaattaaagtctagttgggtttcaagccctaacctccattttagcttccaagaccttgatttctaagtgtttaagccatgatttaacagcataatcacctaatataagtccataggatcatacctgatgaatctcctcaataatctctccacaatcgcccaaaaatgccttagtccgagctcctcttttctcttctctaaatgagtgtttcaaacactctggaaatataaattcccagcgatttccgctcctgcggacatttttccgctccagcggtctcgcataggcgaccaaaattccgctccagcggctttccttcaagatcttagagaccgctgttgcggtcattcttccgcttcagcggttccgctcctgcggaaccatttccgctccagcgatgcccgtccgctccagcggctaaaagtccgccccagcggacccgcctacgcggccgaaattctgctcctgcggaaacaccagaaacagattttcctttttctgctttaaaaccaaaaatgctccgattaaccatccgatttcaccccgaggccctcgggacctcaaccagcaacacatactcaacctataacatcattcaaacttgctcgggccttaaaaacgctaccttaaacaccaaaaatcatcaaaattcaatggattcaattcaaaatgaacttaaactttgaaaatgcaaacccgatcaaaaacccgacttagacatctccgaattatctaaaaatttgcatacaagcccgaaatcacctaacggagctaatgcaactgtcggaattccattccgacccccggatcaaattctcacctatcaaccggattcttccaaaattccaactttggcaaacttagataactttcactcccgaactccgaattcacttccgctttcgccaacaagtcacaaatcaacccccgaaactagtcgagccatcggaaatccgttccgagccctctaacccataagtcaacttttggtcaaccttaccaattcaagtttctcttaaatagactcctcaacctatttctatccaaaaaccaatccaaaccattcccgactccccgaatacacataacaacacgcggggaaacatatgacggggataacgggctgaaatataagaaatgacgggacgggtcattacatcctccccaactaaaacaaacgctcgtcctcgagcgggtcaagaaacatacctggatcaatgaacaaatgaggatatctgctctgcatctcctgctcggtctcccaagtagcctcctccacgggacggcctcgccattgaaccttcactgaggctatatccttagatctcaacttgcgaacctgacgacccaaaatggcaactggctccacatcataagtcaaatcatcatctaactgaatcgagctgaagtccaacacatgggacggatcctccacatacttccggagcatagagacatgaaacaccggatgaacacccgataacctgggcggcaaagcaagctgataggccacctccccaatcttgtcaagaatctcaaaagggcctatatatcgaggactcaactttcctctcttcccaaatctcttaacgcctttcataggcgaaaccttcagcagaaccttctcgccaatcatgaatgataaatctcgaactctccgatcggcataactcttctgacgcgactgagctgtacgaagtcgctcctgaatcaccttcaccttctccaaagcatcctggaccacctctgtacccaacaatctagcctcgccgggctcgaaccaaccaaccggagatctacaccgtctcccatacaaagcctcatacggtgccatctggatactggactgatagttgttattataagcaaactctgcaaggggcaagaaatcctcccaagagccaccaaagtcaatcacacaagcacgcaacatatcctccaatatctgaatcgtgcgctcggactgcccgtccgtctgagggtgaaatgctgaactcaaatgcacctgggtacccatctctcgatgaaaagccttccaaaactgagaagtgaactggggacctctgtctgatatgatagaaactggaacaccatgcaaacgaacaatctcacgaatgaaaatctctgccagccgctgcgaggaatatgtagtacacactgggatgaaatgagcggacttggtcaatcgatccacgatgacccaaatcgaatcaaacttcctcgctgtccgaggcaaaccggtcacaaaatccatcgtgattctttcccatttccactcaggaataaccatctgctgtaataaaccaccaggtcgctgatgctcggacttcacctgctgacaattaagacaccgagctacatgacccaatatatccctcttcataccttcccaccaatatatctgcctcaagtcctggtacatcttcgcgacccccggatgaatggagtatcgcgagctgtgagcctctgccaatatcatctctcgaatcccatcaacatcgggcacgcagatgcggccctgcatcctcagaacaccattgccatcaatagccatatccttggcatcgcccctctgaactcgatctctaagaacctgcaaatgcctatcatgatactggaactctctgatccggtcatataatgaagactgggagaccacgctagccaatacccggctaggctccgaaatatccaaccgaaccatccgattggctaaagcctgaacatcaagagcaaggggtctctccccaactggaatgaacgccaaactgcccatactaaccgccttccgactcaaggcatcggccactacattggccttacccggatgatacaaaatggtaatatcataatctttgagcaactcaagccacctccgctgtctcaaattcaaatctttctgcttaaacaagtgctgaaggctgcgatgatccgtatacacctcgcatgatacaccatagaggtagtgcctccaaatcttcaaagcatgcacaatcgctgccaattctaagtcatgaacagggtagttcttctcatgcggcttcaactgccgagaagcataagcaatcactctaccttcctgcataagaacacagccaataccaatcctcgaagcgtcgcaatatactgtataagaacctgaagctgctggcaatactaacactggagctgtagtcaaagctgacttgagcttctgaaagctctcttcacactcatcagaccaaacaaatggagcattcttctgcgtcaatttagtcaatggcgacgcaatagatgaaaaaccctcaacaaacctgcggtaataacccgccaaaccaaggaaactccgaatctcggtggccgaagacggtctaggccaactctgcaccgcctccaccttcttcggatctaccagaatcccatcactggacaccacgtgccccaagaatgccacagaactaagccagaactcacacttggagaacttagcataaagcttctcctctctcagcctctgcagaacaaccctcaagtgctgcgcgtgctcctcctggctacgcgagtacaccaggatgtcatcaataaacacaatcacaaatgaatccaaatacggctgaaatacactattcatcaagtgcatgaatgcagctggggcatttgtcagcccaaatgacataaccaggaactcataatgcccatatctcgtcctgaaagctgtcttcaaaatatcagaatcccgaatcttcagctgatgatagccagaacgaagatcaatcttggagaaaaccttagctccctggagctgatcaaacaaatcctcaatgcgaggcaatggatacttgttcttcacggtcactctattcaactgcctgtagtcgatgcacattctcattgtgccatctttcttcttcacaaacaacaccggtgcaccccacggtgacacactaggacgaataaaccccttttctaggagttcctgaagctgatctttcaactccttaagctctgcaggtgccatgcgataaggtgggatagaaatgggctgagtgcccggcaccaagtcaatcccaaaatcaatgtccctgtccggcggcatgcccggcaggtcagctggaaacacatcagggaagtccctcaccacggggactgaatcaagactaggagtctcagctcccacatctctaacaaaagccaagtacgataaacaacctttccctaccatccgctgggcctttaggaaagaaatcaccctgctgggtacataatcagtcacaccccgccactcaactcggggaaaaccaggaatagccaaggtaactgtcttagcatgacagtctaagagagcatgacacggggacagccagtccatacccaagatcacatcgaaatccaccatgtctaataacaataagtcaacacgggtctccagacccccaaacataatcaaacaggatcgatatacatgatccacaacaaccgtatcccccaacggggtagatacatgcacaggtgagacaagaatatcacgaaccacacccagatgatgggcgaaataacaagacacataagagtaggtggatcccggatcaaataaaacagaagcatctcggtgacaaaccggaataatacctgtgataacagcatcagatgcaatggcgtcggctctgtccggaatagcataaaacctggcctggccaccgtcagagcggcctctacctctgggtcggcctctacctgcctgaccaccttccctagctgactgaggggaagcagatgaaactggtgcagaagatgagggctggtccctctgctgagatctactaccctgaagtctgggacaaaacctcttcacgtggccaaactcgccacactcaaagcaactgcctggggctggagaaggggactgaagggaacccctcgcaccagaatgacccgccgatctactcggcgctgaagaaccctgagctgatggagcataagaggaaccctgtgcaggaagtgcactcaatgaagactgaccctgctgtgaaccctgatgaccacggcctgaagacgcctcgcgatactcgggacgggccggctgctgctgcctgaaatggcgacctctgccctgctggaactggcccctagacggagctccactgaaaccacccgatccacgaggcctcttggcctctctctcctctctctccaaacgacgatctgtctcaatgtctctagcaatgtcaacagcatcctcaaaggtatggctcagaaccctctctctggacatcaaaatacgaataggataaataagctcgtccacaaatctcctgatccgcacccggtcagtcggaaccatccatggtgcatgacgagccaacttagaaaatctcatctcatactgtgacacagtcatatcaccctgccgaaggtactcaaactgcctacgcagctcctcccgctgagaacgtggcatccacttctccaaaaagagagtggagaactctaaccaagataaaggtgctgctcctgccggcctacgccgctcatatgcctcccaccatgtgaatgctgcacccgaaaactgaaaggtggtgaatgatacaccactactctccaaaatacctgcagtctagagcatacgtcgactcttgtcgagaaatccctgggcatcctcgccctgagccccactgaaagtcggaggcgaaagtctgctgtacctctcgagacgacgctgctcgtcctctggcatagccggaaccataactccctgaaccggaacaacctgtggcgctggagcaataggggctgcctcaggggtctgcaagccctgagcaccctgtggaactggagcaataggggctgcctcaggggtctgtaagccctgagcaacctgctctggagtctgagcagcaggggtctgatgtcctccccctgtctgagatgctgctgctgctgtagaagctgatacgacctgagctaggccggtgcaaactgacagtatctgggccagggtctcctgaagacccggaatgacaaagggcacggcctgtgcctgagctggtgctgcgggagtctcctccgctgatgcctgatcctgaacctgggcagccggtggatcaataggtgctgccgctgtggctctgcctcgaccacgcccgcgaccgcgtccacggcctctggcaggtgatactggtggtcgtccggcacctctggtagcacgtgttctcgccatctgcgagagaatagaataatagaatttagttttcagatcaatcagatcgcacgacagaatttcaagaatgtgaagtgtttcctaacagttctgtagcctcccgtggatatgatacggacgtctacgcaccgatccacaagactctactaaaccggctcatgactcgtgagaccaagtaacctaggctctgataccaagttgtcacgaccccaatcccggtcgcgatggcgcccggccgtaaggctaggcaagcctgaccaacataccaatatttcccagaacaacagaattaaagtaacaaaacttaagaaggaagagaattcaaataccaaaaccacggaaatcaaaatatcccacaaaccaccgaggaatcggtgtcacaagtttgagcctctaaagtaaaatattaatccgatacaaccgttcgaaaactgaaagtgtaataacaaggaaaagtaagatagagggagggtcgatggctgcgaacgccgtgcagctacctcaactctccgaagctggatcctgaagactccggaagctagcccgcctgagtatgccctggatctgcacacatggtgcagggagtaatgtgagtactccgacccagtgagtaataacagtaaataaagtctgaaggaaagaaaccacagatatgcacaaggtaaagctaagaacagtatatatgacaatgactgaaaccaactaaagatgcacaataaataagatgcaatgcaggaatgctatgcaatgcaatgccggtactctccggtacccatcatttatcgtcgacggcgctcactgggggtgtatacagactccggaggggctcctacagcccaagcgcaataatcagccatctcgtggtggcaaaatacgacatagtgtccatgttaccactggtccagacaataacccggtcagtccatgttaccctgaccgctcatacgacacagtgtccgtgttaccactggtccaaacaccgatacggcacgcagccgagccaaccaatatcagtccagaaaatatcacaagccacttgggcagttataaatcatgatcctcagccgaaatacattttaaaagatatcaagtgagtttgaacattgaaatacggctgggttttgaaaacaatgctttaagaagccatggacgatacgtatgatatgcaatcatgataaacaatgatatcaactctcgaagagtatcacaggtcggcactaggccccaaacacggcatatagccccatattaatcacaacagtacgcgtatcatacgccaatatagtatagaataacacacgggatggaccaagtcgcaatccccatcaacatccgactccgcacctgtccaggagtgcgagtcacgcctcgatatagcgttacgatgtggaagtccggggtttcaaaccctcagaacagcatttactagcattactcacctctagccggccgtagactagcccgaaatgcccttccgcctcaaatccgcctctacgagcgtcgaatctggccaaaaccacaacgaataggttacataatgctaaggggacataacccaatcgaaagaactcgaaaaacaacacaaatcgcgaaaatagcaaaacccgagccccgggcccacacctcgaaaaccagaaaactttacaccaaaatgaccctcgcctcgccacgagtccatacatataaaattcatcaaaatcggagtctaattgctccctcaaatcatcaattaaagtctagttgggtttcaagccctaacctccatttttagcttccaagaccttgatttctaagtgtttaagccatgatttaacagcataatcacctaatataagtccataggatcatacctgatgaatctcctcaataatctctccacaatcgcccaaaaatgccttagtccgagctcctcttttctcttctctaaatgagtgtttcaaacactctggaaatataaattcccagcgatttccgctcctgcggacatttttccgctccagcggtctcgcataggcgaccaaaattccgctccagcggctttccttcaaaatctcagagaccgctgttgcggtcattcttccgcttcagcggttccgctcctgcggaaccatttccgctccagcggctaaaagtccgccccagcggacccgcctacgcggccgaaattccgctcctgcggaaacaccagaaacagattttcctttttctgctttaaaaccaaaaatgctccgattaaccatccgatttcaccccgaggccctcgggacctcaaccagcaacacatactcaacctataacatcattcaaacttgctcgggccttaaaaacgctaccttaaacaccaaaaatcatcaaaattcaatggattcgattcaaaatgaacttaaactttaaaaatgcaaacccgatcaaaaacccgacttagacatctccgaattatctaaaaatttgcatacaagcccgaaatcacctaacggagctaatgcaactgtcggaattccattccgacccccggatcaaattctcacctatcaaccggattcttccaagattccaacttcggcaaacttagataactttcactcccgaactccgaattcacttccgcttccgccaacaagtcacaaatcaacccccgaaactagtcgagccatcggaaatccgttccgagccctctaacccataagtcaacttttggtcaaccttaccaattcaagtttctcttaaatagactcctcaacctatttctatccaaaaaccaatccaaaccattcccgactccccgaatacacataacaacacgcggggaaacatatgacggggataacgggctgaaaaataagaaatgacgggacgggtcattacatcctccccaactaaaacaaacgctcgtcctcgagcgggtcaagaaacatacctggatcaatgaacaaatgaggatatctgctccgcatctcctgctcggtctcccaagtagcctcctccacgggacgacctcgccactgaaccttcactgaggctacatccttagatctcaacttgcgaacctgacgacccaaaatagcaactggctccacatcataagtcaaatcatcatctagctggatcgagctgaagtccaacacatgggacggatcctccacatacttccggagcatagagacatgaaacaccggatgaacacccgataacctgggcggcaaagcaagctgataggccacctccccaatcttgtcaagaatctcaaaagggcctatatatcgaggactcaactttcctctcttcccaaatctcttaacgcctttcataggtgaaaccttcagcagaaccttctcgccaatcatgaatgacaaatctcgaactctccgatctgcataactcttctgacgtgactgagcagtacgaagtcgctcctgaatcaccttcaccttttccaaagcatcctgaaccacctctgtacccaataatctagcctcgccgggctcgaaccaaccaaccggagatctacaccgtctcccatacaaagcctcatacggcgccatctggatactggactgataactgttattgtaagcaaactctgcaaggggcaagaattcctcccaagagccaccaaagtcaatcacacaagcacgcagcatatcctccaatatctgaatcgtgcgctcggactgcccgtccgtctgagggtgaaatgctgaactcaaatgcacctgggtacccatctctcgatgaaaagccttccaaaactgagaagtgaactggggacctctgtctgatataatagaaactggaacaccatgcaatcgaacaatctcaagaatgaaaatctctgccagccgctgcgaggaatatgtagtacacaccggaatgaaatgagcggacttggtcaatcgatccacgatgacccaaatcaaatcaaacttcctcgctgtccgaggcaaaccggtcacaaaatccatcgtgattctttcccatttccactcaggaataaccatctgctgtaataaaccaccaggtcgctgatgctcggacttcacctgctgacaattaagacacctagccacatgacccaatatgtccttcttcataccttcccaccaatatatctgtctcaaatcctggtgcatcttcgcgactcccggatggatggagtatcgcgagctgtgagcctctgccaatatcatctctcgaatcccatctacatcgggcacgcagatacggccctgcatcctcagaacactattgccatcaatagtcatatccttggcatcgcccctctgaactcgatctctaagaacctgcaaatgcctatcgtggtactggaactctctgatccggtcatataatgaagactgggagaccacgctagccaatacccggctaggctccgaaatatccaaccgaaccatccgattggctaaagcctgaacatcaagagcaaggggtctctccccaactggaatgaacgccaaactgcccatactaaccgccttccgactcaaggcatcggccactacattggccttacccggatgatacaaaatggtaatatcataatctttgagcaactcaagccacctccgctgtctcaaattcaaatctttctgcttaaacaagtgctgaaggctgcgatgatccgtatacacctcacatgatacaccatagaggtagtgcctccaaatcttcaaagcatgcacaatcgctgccaactctaagtcatgaacagggtagttcttctcatgcggcttcaactgccgagaagcataagcaatcactctaccctcctgcataagaacacagccaataccaatcctcgaagcgtcgcaatatactgtataagaacctgaagctgctggcaatactaacactggagctgtagtcaaagctgacttgagcttctggaagctctcttcacactcatcagaccaaacaaatggagcattcttctgcgtcaatttagtcaatggcgacgcaatagatgaaaaaccctcaacaaacctgcggtaataacccgccaaaccaaggaaactccgaatctcggtggccgaagacggtctaggccaactctgcactgcctccactttcttcggatctaccagaatcccatcactggacaccacgtgccccaagaatgccacagaactaagccagaactcacacttggagaacttagcataaagcttctcctctctcagcctctgcaaaacaaccctcaagtgctgcgcgtgctcctcctggctacgcgagtacaccaggatgtcatcaataaacacaatcacaaatgaatccaaatacggctgaaatacactattcatcaagtgcatgaatgcagctgggaaatttgtcagcccaaacgacataaccagaaactcataatgcccatatctcgtcctgaaagctgtcttcaaaatatcagaatcctgaatcttcggctgatgatagccagaacgaagatcaatcttggagaaaaccttagctccctggagctgatcaaacaaatcctcaatgcgaggcaatggatacttgttcttcacggtcactctattcaactgcctgtagtcgatgcacattctcattgtgccatctttcttcttcacaaacaacaccggtgcaccccacggtgacacactaggacgaataaaccccttttctaggagttcctgaagctgatctttcaacttcttaagctctgcaggtgccatacgataaggtgggatagaaatgggctgagtgcccggcaccaagtcaatcccaaaatcaatgtccctgtccggcggcatgcccggcaggtcagctggaaacacatcagggaagtccctcaccacggggactgaatcaagactaggagtctcagctcccacatctctaacaaaagccaagtacgataaacaacctttccctaccatccgctgggcctttaggaaagaaatcaccctgctgggtacataatcagtcacaccccgccactcaactcggggaaaaccaagaatagccaaggtaactgtcttagcatgacagtctaagagagcatgacacggggacaaccagtccatacccaagatcacatcgaaatccaccatgtctaataacaataagtcaacacgggtctccagacccccaaacataatcaaacaggatcgatatacatgatccacaacaaccgtatcccccactggggtagatacatgcacaggtgagacaagaatatcacgaaccacacccagatgatgggcgaaataacaagacacataagagtaggtggatcccggatcaaataaaacagaagcatctcggtgacaaaccggaataatacctgtgataacagcatcagatgcaatggcgtcggctctgtccggaatagcataaaacctgacctggccaccgtcagagcggcctctacctctgggtcggcctctacctgcctgaccaccttccctagctgactgaggggaagcagatgaaactggtgcagaagatgagggctggtccctctgctgagatctactaccctgaagtctgggacaaaacctcttcacgtggccaaactcgccacactcaaagcaactgcttggggctggagaaggggactgaagggaacccctcgcaccagaatgacccgccgatctactcggcgctgaagaaccctgagctgatggagcataagaggaaccctgtgcaggaagtgcactcaatgaagactgaccctgctgtgaaccctgatgaccacgacctgaagacgccccgcgatactcgggacgggccggctgctgctgcctgaaatggcgacctctgccctgctagaactggcccctagacggagctccactgaaaccacccgatccacgaggcctcttggcctctctctcctctctctccaaacgacgatctgtctcaatgtctctagcaatgtcaacagcatcctcaaaggtatggctcagaaccctctctctggacatcaaaatacgaataggataaataagcccgtccacaaatctcctgatccgcacccggtcagtcggaaccatccatggtgcatgacgagccaactcagaaaatctcatctcatactgtgacacagtcatatcaccctgccgaaggtactcaaactgcctacgcagctcctcccgctgagaatatggcatccacttctccaaaaagagagtggagaactctaaccaagataaaggtgctgctcctgccggcctacgccgctcatatgcctcccaccatgtgaatgctgcacccgaaaactgaaaggtggtgaatgatacaccactactctccaaaatacctgcagtctggagcatacgtcgactcttgtcgagaaatccctgggcatcctcgccctgagccccactgaaagtcggaggcgaaagtctgctgtacctctcgagacgacgctgctcgtcctctggcatagccggaaccataactccctgaaccggaacaacctgtggcgctggagcaataggggctgcctcaggggtctgcaagccctgagcaccctgctctggagtctgagcagcaggggtctgatgtcctcccccggtctgagatgctgctgctgctgtagaagctgatacgacctgagctaggccggtgcaaactgacagtatctgggccagggtctcctaaagacccggaatgacaaagggcacggcctgtgcctgagctgatgctgcgggagtctcctccgctgatgcccgatcttgaacctgggtagccggtggatcaataggtgctgccgctgtggctctgcctcgaccacgcccacgaccgcgtccgcggcctctggcaggtgatactggtggtcgtccggcacctctggtagcacgtgttctcgccatctgggagagaatagaataatagaatttagttttcagatcaatcagatcgcacgacagaatttcaagaatgtgaagtgtttcctaacagttctgtagcctcccgtggatatgatacggacgtctacgcaccgatccacaagactctactaaaccggctcatgactcgtgagacccagtaacctaggctctgataccaagttgtcacgaccccaatcccggtcgcgatggcgcccggccgtaaggctaggcaagcctgaccaaaataccaacatttcccagaacaacagaattaaagtaacaaaactcaagaaggaagagaattcaaatactaaaaccacagaaatcaaaatatcccacaaaccaccgaggaaccggtgtcacaagtttgagcctctagagtgaaataataatctgatacaaccgttcgaaaactgaaagtgaaataacaaggaaaataagatagagggagggtcgatggctgcgaacgccgtgcagctacctcaactctccgaagttggatcctgaagactccggaagctagcccgcctgagtatgccctggatctgcacacatggtgcagggagtaatgtgagtactccgacccagtgagtaataacagtaaataaagtctgaagaaaagtaaccacagatatgcacaaggtaaagctaagaacataatatatgacagtgactgaaaccaagtaaagatgcacaataagtaagatgcaatgcaggaatgctatgcaatgcaatgccggtactctccggtacccatcatttatcgtcgacggcgctcactgggggtgtatacagactccggaggggctcctacagcccaagcgcaataatcagccatctcgtggtggcaaaatacgacacagtgtccatgttaccactggtccacacaataacccggtcagtccatgttaccctgaccgctcatacgacacagtgtccgtgttaccactggtccaaacaccgctacggcacgcagccgagccaaccaatatcagtccagaaaatatcacaagccacttgggcagttataaatcatgatcctcagccggaatacatttttaaaagatatcaagtgagtttgaacattgaaatacggctggttttttttttgaaaacaatgctttaagaagccatggactgatatgaatgatatgcaatcatgataaacaataatatcatctctcgaagagtatcacagatcggcactaggccccaaacacggcatatagccccatattaatcacaacagtacgcgtatcatacgccaatatagtatagaataacacacgggatggaccaagtcgcaatccccatcaacatccgactccgcacctgtccaggagtgcgagtcacgcctcgatatagcgttacgatgtggaagtccggggtttcaaaccctcagaacagcatttacaatcattactcacctctagccggccgtagactagctcgaaatgccctttcacctcgaatccgcctctacgagcgtcgaatctggccaaaaccacaacgaatatgttacacaatgctaaggggacataacccaattgaaagaactcgaaaaacaactcaaattgcgaaaatagcaaaacccgagccccgggcccacatctcgaaaaccagaaaactttacaccaaaacgaccctcgtctcgccacgagtccatacatataaaattcatcaaaatcggagtctaattgctccctcaaatcatcaattaaagtctagttgggtttcaagccctaacctccatttttagcttccaagaccttgatttctaagtgtttaagccatgatttaacagcataaccacctaatataagtccataggatcatacctgatgaatctcctcaataatctctccacaatcgcccaaaaaatgccttagtccgagctcctcttttctcctctctaaatgagtgtttcaaacactctggaaatataaattcccagcgatttccgctcctgcggacatttttccgctccagcggtctcgcataggcgaccaaaattccgctccagcggctttccttcaaaatctcagagaccgctgttgcggtcattcttccgcttcagcggttccgctcctgcggaaccatttccgctccagcgatgcccgtccgctccagcggctaaaagtccgccccagcggacccgcctacgcggccgaaattccgctcctgcggaaacaccagaaacagattttcctttttctgctttaaagccaaaaatgctccgattaaccatccgatttcaccccgaggccctcgggacctcaaccagcaacacatactcaacctataacatcattcaaacttgctcgggccttaaaaacgctaccttaaacaccaaaaatcatcaaaattcaatggattcagttcaaaatgaacttaaactttgaaaatgcaaacccgatcaaaaacccgacttagacatctccgaattatctaaaaatttgcatacaagcccgaaatcacctaacggagctaatgcaactgccggaattccattccgacccccggatcaaattctcacctatcaaccggattcttccaaaattccaacttcggcaaacttagataactttcactcccgaactccgaattcacttccgctttcgccaacaagtcacaaatcaacccccgaaactagtcgagccatcggaaatccgttccgagccctctaacccataagtcaacttttggtcaaccttaccaattcaagtttctcttaaatagactcctcaacctatttctatccaaaaaccaatccaaaccattcccgactccccgaatacacataacaacacgcggggaaacatatgacggggataacgggctgaaatataagaaatgacgggacgggtcattacatcctccccaactaaaacaaacgttcgtcctcgagcgggtcaagaaacatacctggatcaatgaacaaatgaggatatctattccgcatctcctgctcggtctcccaagtagcctcctccacgggacgacctcgccactgaaccttcactgaggctatatccttagatctcaacttgcgaacctgacgacccaaaatggcaactggctccacatcataagtcaaatcatcatctagctgaatcgagctgaagtccaacacatgggacggatcctccacatacttccggagcatagagacatgaaacaccggatgaacacccgataacctgggcggcaaagcaagctgataggccacctccccaatcttgtcaagaatctcaaaagggcctatatatcgaggactcaactttcctctcttcccaaatctcttaacgcctttcataggcgaaaccttcagcaggaccttctcgccaatcatgaatgatagatctcgaactctccaatctgcataactcttctgacgtgactgagctgtacgatgtcgctcctgaatcaccttcaccttttccaaagcatcctgaaccacctctgtacccaataatctagcctcgccgggctcgaaccaaccaaccggagatctacactgtctcccatacaaagcctcatacggcgccatctggatactggactgatagctgttattataagcaaactctgcaaggggaaagaattcctcccaagagccaccaaagtcaatcacacaagcacgcaacatatcctccaatatctgaatcgtgcgctcggactgcccgtccgtctgagggtggaatgttgaactcaaatgcacctgggtacccatctctcgatgaaaagccttccaaaactgagaagtgaactggggacctctgtctgatataatagaaactggaacaccatgcaatcgaacaatctcacgaatgaaaatctctgccagccgctgcgaggaatatgtagtacacaccggaatgaaatgagcggacttggtcaatcgatccacgatgacccaaatcgaatcaaacttcctcgctgtccgaggtaaaccggtcacaaaatccatcgtgattctttcccatttccactcaggaataaccatctgctgtaataaaccaccaggtcgctgatgctcggacttcacctgctgacaattaagacaccgagctacatgacccaatatatccttcttcataccttcccaccaatatatctgtctcaagtcctagtacatcttcgcgacccccggatgaatggagtatcgcgagctgtgagcctctgccaaaatcatctctcgaatcccatctacatcgggcacgcagatacggccctgcatcctcagaacaccatcaccatcaatagtcatatccttggcatcgcccctctgaactcgatctctaagaacctgcaaatgcctatcatgatactggaactctctgatccggtcatataatgaagactgggagaccacgctagccaatacccggctaggctccgaaatatccaaccgaaccatccgattggctaaagcctgaacatcaagagcaaggggtctctccccaactggaatgaacgccaaactgcccatactaaccgccttccgactcaaggcatcagccactacattggccttactcggatgatacaaaatggtaatatcataatctttgagcaactcaagccacctccgctgtctcaaattcaaatctttctgcttaaacaagtgctgaaggctacgatgatccgtatacacctcacatgatacaccatagagcccgttatccccgttatatgcttccccgcgtgttgttatgtgtattcggggagtcgggaatggtttggattgtgtttattgatgacatcctggtgtactcgcgtagccaggaggagcacgcgcagcacttgagggttgttttgcagaggctgagagaggagaagctttatgctaagttctccaagtgtgagttctggcttagttctgtggcatttttggggcacgtggtgtccagtgatgggattctggtagatccgaagaaagtggaggcagtgcagagttggcctagaccgtcttcggccaccgagattcggagtttccttggtttggcgggttactaccgcaggtttgttgagggtttttcatctattgcgtcgccattgactaaattgacgcagaagaatgctccatttgtttggtctgatgagtgtgaagtgagctttcagaagctcaagttagctttgactacagctccagtgttagtattgccagcagcttcaggttcttatacagtatattgcgacgcttcgaggattggtattggctgtgttcttatgcaggagggtagagtgattgcttatgcttctcggcagttgaagccgcatgagaagaactaccctgttcatgacttagagttggcagcgattgtgcatgctttgaagatttagaggcactacctctacggtgtatcatgtgaggtgtatacggatcatcgcagccttcagcacttgtttaagcagaaagatttgaatttgagacagcggaggtggcttgagttgctcaaagattatgatattaccattttgtatcatccgggtaaggccaatgtagtggccgatgccttgagtcggaaggcggttagtatgggcagtttggcgttcattccagttggggagagaccccttgctcttgatgttcaggctttagccaatcggatggttcggttggatatttcggagcctagccgggtattggctagcgtggtctcccagtcttcattatatgaccggatcagagagttccagtatcatgataggcatttgcaggttcttagagatcgagttcagaggggcgatgccaaggatatgactattgatggtgatggtgttctgaggatgcagggccgtatctgcgtgcccgatgtagatgggattcgagagatgattttggcagaggctcacagctcgcgatactccattcatccgggggtcgcgaagatgtactaggacttgagacagatatattggtgggaaggtatgaagaaggatatattgggtcatgtagctcggtgtcttaattgtcagcaggtgaagtccgagcatcagcgacctggtggtttattacagcagatggttattcctgagtggaaatgggaaagaatcacgatggattttgtgaccggtttacctcggacagcgaggaagtttgattcgatttgggtcatcgtggatcgattgaccaagtccgctcatttcattccggtgtgtactacatattcctcgcagcggctggcagagattttcattcgtgagattgttcgattgcatggtgttccagtttctattatatcagacagaggtccccagttcacttctcagttttggaaggcttttcatcgagagatgggtacccaggtgcatttgagttcaacattccaccctcagacggacgggcagtccgagcgcacgattcagatattggaggatatgttgcgtgcttgtgtgattgactttggtggctcttgggaggaattctttccccttgcagagtttgcttataataacagctatcagtccagtatccagatggcgccgtatgaggctttgtatgggagacagtgtagatctccggttggttggttcgagcccggcgaggctagattattgggtacagaggtggttcaggatgctttggaaaaggtgaaggtgattcaggagcgacatcgtacagctcagtcacgtcagaagagttatgcagattggagagttcgagatctatcattcatgattggcgagaaggtcctgctgaaggtttcgcctatgaaaggcgttaagagatttgggaagagaggaaagttgagtcctcgatatataggcccttttgagattcttgacaagattggggaggtggcctatcagcttgctttgccgcccaggttatcgggtgttcatccggtgtttcatgtctctatgctccggaagtatgtggaggatccgtcccatgtgttggacttcagctcgattcagctagatgatgatttgacttatgatgtggagccagttgccattttgggtcgtcaggttcgcaagttgagatctaaggatatagcctcagtgaaggttcagtggcgaggtcgtcccgtggaggaggctacttgggagaccgagcaggagatgcggagcagatatcctcatttgttcattgatccaggtatgtttcttgacccgctcgaggacgagcgtttgttttagttagggaggatgtaatgacccgtcccgtcatttcttatatttcagcccgttatccccgtcacatgtttccccgcgtgttgttatgtgtattcggggagtcgggaatggcttgaattggtaaggttgaccaaaagttgacttatgggttagagggctcggaacggatttccgatggctcgactagtttcgggggttgatttgtgacttgttggcgaaagcggaagtgaattcggagtttgggagtgaaagttatctaagtttgccgaagttggaattttggaagaatccggttgataggtgagaatttgatccgggggtcggaatggaattccgacagttgcattagctccgttaggtgatttcgggcttgtatgcaaatttttagataattcggagatgtctaagtcgggtttttgatcgggtttgcatttttaaagtttaagttcattttgaatcgaatccattgaattttgatgatttttggtgtttaaggtagcgtttttaaggcccgagcaagtttgaatgatgttataggttgagtatgtgttgctggttgaggtcccgagggcctcggggtgaaatcggatggttaatcggagcatttttggttttaaagcagaaaaaggaaaatctgtttctggtgtttccgcaggagcggaatttcggccgcgtaggcgggtccgctggggcggacttttagccgctggagcggaaatggttccgcaggagcggaaccgctgaagcggaagaatgaccgcaacagcggtctctgagattttgaaggaaagccgctggagcggaattttggtcgcctatgcgagaccgctggagcggaaaaatgtccgcaggagcggaaatcgctgggaatttatatttccagagtgtttgaaacactcatttagagaagagaaaagaggagctcggactaaggcatttttgggcgattgtggagagattattgaggagattcatcaggtatgatcctatggacttatattaggtgattatgctgttaaatcatggcttaaacacttagaaatcaaggtcttggaagctaaaaatggaggttagggcttgaaacccaactagactttaattgatgatttgagggagcaattagactccgattttgatgaattttatatgtatggactcgtggcgaggcgagggtcgttttggtgtgaagttttctggttttcgaggtgtgggcccggggctcgggttttgctattttcgcgatttgtgttgtttttcgagttctttcgattgggttatgtccccttagcattatgtaacctattcgttgtggttttggccagattcgacgctcgtagaggcggatttgaggcggaagggcatttcgggctagtctacggccggctagaggtgagtaatgctagtaaatgctgttctgagggtttgaaaccccggacttccacatcgtaacgctatatcgaggcgtgactcgcactcctggataggtgcggagtcggatgttgatggggattgtgacatggtccatcccgagagagattctatactatattggcgtatgatacgcgtactgttatgattatcattgggctatatgccgtgtttggggcctagtgccgacctgtgatactcttcgagagttgatatcaatttttatcatgattgcatatcattcatatcagtccatggcttcttaaagcattgttttcaaaacccagccgtatttcaaatgttcaaactcacttgatatcttttaaaaatgtattccggctgaggatcatgatttataactgcccaagtggcttgtgatattttctggactgatattagttggctcggctgcacgccgcagcggtgattggaccagtggtaacatggacactgtgtcgtatgtgcggtcagggtaacatggactgaccgggttattgtttggaccagtggtaacatggacactgtgtcgtattttgccaccacgagatggctgattattgcgcttgggctgtaggagcccctccggagtctgtatacacccccagtgagtgccgtcgacgataaatgatgggtaccggagagtaccggcattgcattgcatagcattcctgcattgcatcttacttattgtgcatctttacttggtttcagtcactgtcatatatactgttcttagctttaccttgtgcatatctgtggtttcttttcttcagactttatttactgttattactcactgggtcggagtactcacattactccctgcaccatgtgtgcagatccagggcatactcaggcgggctagcttccggagtcttcaggatccagctttggagagttgaggtagctgcacggcgttcgcagccatcgaccctccctctatcttacttttccttgttattacactttcagttttcgaacggttgtatcagattaatattttactctagaggctcaaacttgtgacaccggttcctcggtggtttgtgggatattttgactttccgtggttttaagtatttgaattctcttccttcttaagttttgttactttaattctgttgtttggggaaatattggtattttggtcaggcttgcctagccttacggccgggcgccctcgcgaccgggattggggtcgtgacaaaaataaagacaaaataacttatagaaatttaataaacaaattagcaatatgtaatatgtgttatatagacgaatacacttgcgcatttagagactattattatagaggaatttacaatatagaggaaagtaaagaaataagaaaattatattttacaaaattaccagaaccttttagctcaaaaataatcaaagactggaatgaagcaaacatatcagataccttaggatcaagaataaaatttctacaacaatggtatatggatacatgtgaaaaatacaaagaagaattaaaaatggaaaaaacattaataaaaaacctatcatgttgttgtttgcaataaatttatgggcagaaaaataaaactgcaattacaaacaactctgaagaaaaaaggattttattgataaacattgcaggttacaactctgtttatcccttgattcttactccgaactgttctccgtgattcgagggccttagcggcatatttcccgaacgtaggatgatgctgatcttactggggatatatttgatctccagcttcttgaactatttgactgtcaagaagaatccgaccatattttggtctcgttgtgagtatcccgtgagtttatgggattttttgagacccctcttcaagggaatatgtatccctttatatacgtgtgagttagggtttagggtagagtaacctccaagaaaccctagtagactcctaatagactcataggatttctagagttctatagtatctttaatttaggatttggcttgatcccttaaaatttcagtgtctacaaatgccccctacttcaaggtttgtcgaggtgtaggcttgctgaaacttgaagacgagacttgaagtacccgaccatcatagcatataatcttgtaacttgaagtttttgatttgcaggaggaagagatgaagggcagaactggtcccactgggcgtgccaatttgtttgcaataaatttatgggcagaaaaataaaactgcaattacaaacaactctgaagaaaaaaggattttattgataaacattgcaggttacaactctgtttatcccttgattcttcctccaaactgttctccgtgattcgagggccttagcggcatatttcccgaacgtaggatgatgctgatcttactggggatatatttgatccccaacttcttgaactatttgattgtcaagaagtatccgaccatattttggtctctttgtgagtatcccatgagtttatgggatttttggagacacctcttcaagggaatatgtatccctttatataggtgtgagttagggtttagggtagagtaacctccaagaaaccctagtagactcctaatagactcataggatttctagagttctatagtatctttaatttaggatttggcttgatcccttaaaatttcagtgtctataaatgccccctacttcaaggtttgtcgaggtgtaggcttgctgaaacttgaagacgagacttgaagtacccgaccatcatagcatataatcttgtaacttgaagtttttgatttgcaggaggaagagatgaagggcagaactggtcccactgggcgtgccaatttgtttgcaataaatttatgggcagaaaaataaaactgcaattacaaacaactctgaagaaaaaaggattttattgataaacattgcaggttacaactctgtttatcccttgattcttcctccaaactgttctccgtgattcgagggccttagcggcatatttcccgaacgtaggatgatgctgatcttactggggatatatttgatctccagcttcttgaactatttgactgtcaagaagaatccgaccatattttggtctcgttgtgagtatcccgtgagtttatgagattttttgagacacctcttcaagggaatatgtatccctttatataggtgtgagttagggtttaaggtagagtaacctccaagaaaccctaatagactcctaatagactcctaggatttctagagtcctataatatctttaatttaggatttggcttgatcccttaaaatttcagtgtctacaggtatataaccagagaatgaaacataattttcttaaaaagcctttctctataagttttttattattattaagataattaaattatataaaattaattagttttaattctatgatcaagaaaatttgaattactgggtgtattttttaaatatcatacaaaaaattaataaatataattttagtaattttgaagttctaatattagaaaaaataacatgaaaaatgttattatgttacatacttcaaataaggacatgagtttagttgttcaaggtaaaatcttaatttattaaaattttaaatattagaatttcctccataatccaaataaatagatatttaataatcaaaatttagttgatataaaagttttaaatatttaaaaataattgtattatcattttttcaaatgactaatttaaaagtattttaccttatttttcaattatagcgagttgtatgtttatgttttcgaaattttcccatatatttctcccgcattatctcaaaacttgggttttgagtttagaaaaatcgaaggagaaccaaccgatattatacaagacattggataacccatccagtcctctatcgcatcgaattgacgaattcattctgttgtgtaaaatcagtgaaggtggtggtgctcaaacaccaacgatgtttgaaaaatcagaataatctactgccttaatgaaatcagtataatagtaacaagacagctgaagagaggatgacgtagacaagaatcaacctcttcccggtgaggttttgatgtatcgcacaatccgaaaagcagcttctaagtgagatgatctccgcttgtccatataaaatcggctgatcactccctcctatgttgtaagtgtaagcaatgtctgggcgataattagtcaggtagaaaagagtcccaacaagtctccttgcaagtagatgggtcatccaatagctttcctgcatctgaggctaattttaggtcttattccggtttgcatgcagaaagaccagcttttgacaataaattatataatccaaaaaagcaatcagattctataaaatataacaaaaacctaaatatccaagaaataatgaagagaaaaagagaagaagcggcagacccagatatatgacgccaaaagagccgcttccaatcttcctacctaacttgtacttctccccaattattctctccatatagatttattacccctccccctagtctgttcttgattcaatcaacagtagatcttctgaattgaaaaccaacaagtaatacaatgaaatggaggcaggattgaactcctgggggagaagaatacaagtactagacttgacttttcctccctaggacgggatttttgtccacataaccattatggtcgtttggtgagtttttgaccaaatgatccctcaaatttaagagttcgtctaattttatccttttaaaatataacactcagcataaatagtcctctaagcttttattttgctgcaattttgatctcggacaaacgggataataaaatttaacgaatgactttacacagtggtgagtctggttactgcacaaaacaaacaatttactcttggccaggttttctcaaatatcgctccgaaatttcaataggactagtcttacaagttgtttggatggttgtgacctatcatttcataatgtatcgtatcgtattatattgtattatagtgtattgtttgatgaatacaatatttggatgaattgtatcgttttgccgtcgtttcatggtatcatgcaccagtaatatgatgaataaacttgcaatattacaaagaaaaattatgatatggtaaataaaaaggtagggtaaatgataaaataaaattatttaataataatgaagggtgagattgagagaaaaatacaaggaaacgacgcgaccacaccaaatcggtcgttacataaagtggcacatttcatcgttacgtaatgacgaatttaacgatacgatacaataaaatttaagtaacaatcaaaacaaacattgtatttaaagtaacaatacgatacgatacaatatgtaacaaccatccaaacaagctgttaatgtaaacatatgaaatatactacctatcaattagttatattgtctatctaattatgactttgactttttatttctaatcaggcagggattaataaatattctacttgggttggaaaacaattctaaaataaacctcctttaatgtaggttaatttactttattgattcagagtaattttttcttcaatatcaaatatttagcaattttttgtatatagtatgggtacatatttaaaaacaactcttttaattatctcaacatatatttcgaatattatttatattgattttaaagcgatatgtctttattatcggggtacacgcgcaacgcgcgtactctaagactagtactatattaaaagcacgaaggtccttagcgaaatgtcgttcgccttttttaccctttagaaatagatttcacactggacaaaatagtcatttgattatttttctaatattagtaatagtcatttaatatttttctaaatatttaggaattcgagattaactagattttgtgtataatattcttccttatttaaactatgtaacataataaacttgtaaaagaaagatcaaaatattttgtaaaagtgttccaaatcagtcgtttacataaactttgaagcacttttacgtcttgggggtacttttgttcgtcacatttcaacaattaattcttttaaacaattaggtaatccaggtaaaagttttgagtaatttcaatttctttttggtttaagagtttttttcctcttttgttataagttattaaaaattgaggatttgatgtaggtttgggaatattttttttaaaaaaaaattaaccaattaattctttataagaaaaagattaattccttgtaattatgttaggtaaaaataatattacttactttataaatatttcaggtaaactttttgtgcactggacctccttttaggtttatgaattttttttatttttttatttttggtaaaattctcaagcactcgtacctccttttaagtttaggagtatgtgtttgtgtataattcctaatattaaggacggtaatttcttatatctttttgttcatgattctttctttttttaggttacttacgagatacaaaagaattgtgattgaatcctagaggcacacccttccttttaggatttttttttattcctttaaatttaaggtcttatctttcttcattaaacttttgagatttttgtacagaaagtatattaatatccaagcttaaatttttctcaacagattcaagcttaaattttacaacttataaaacaggtcttgtgggaagaaaattgaatttgggccaagaatcgagactgtacaacaggtattattcaaaaagataattgaaatttttcctcttcgttaaaaaggactctctaccgctatcttcttgttaaatgtaaattcatgctaaataaaattgtaaaacggaatattgtgtactttgcctaatagaggagtcagaaatcacttaaaattttaatgatctatgggataaactttgtcctttctttattgtattcagactatgaattatatctattcccagatcattatttgtaggctcaaaactaatgattatggcaagttacgctagagtgtagctttgtcttttaggtttgcttttacgttgtctacgttaagtatgcatactacgttcgacaatgaaagagattacctgtgtagcatgagtctcaatttccaacagaaaaagctttctgttgtttgcaatgcaaagtccttgatagagggccataagttctgagtggattggattttctgtaataacttttgaaccatacccaattagccagtctccttggtcatttcttatcaccccaccaatgcatcccacattgtttatgagctacttcatacccctgcctgaagatgtgatgcatttctacggtatccatttgatctagaagtgacctgcagcaattaataagagaattgtaagttttgcatccatcacggatgaaagagattatctgtgtagcatcagtctcaatttccaacggaaaaagctttctgttgtttgcaatgcagagtccttgatagagggccataagttctgagtggattggattttttgtaataacttttgaaccatacccaattagccagtctccttggtcatttcttattaccccaccaatgcttcccacattgtttgctttgttatagacgccatctatattgagcttgaatcagcctgcatggggctttgtccacaagtttaattgtatatagttcattgaagttattatgttcttcatttggatttttttattttcggtaaatttactcttttgaatcttttattccatttataactttgaatcgattgttataattaactacgttgattagcttacgaaacgtttttcataattttttttaattaaatattttacttagtaagctgttattattattgtaaagtaaatgcatcaatgattaaatgatagagagttattgtttttgttttaaatgatttgactttttatgaccaacaatatcgtctatgaaagagaaaatagattagattcaataatatactaacatattattatctcatacaataaaatacctataattaacttaactatattatttatttattaagttcaaaaaaaatctaattactacgtttatgtaatcactttttttattactaaatgattgttattttaatggcattcgctaatttacataatcaattgttcttgtatacaagttttaattgactgatgttatatatacgtgcaacgcacgtacactaagactagtaatgtaaataaacaaaaatgtagaaattatttaacgaatctaatgtagaacaaaatataaaactgttttgcttgatattagaataaacataccaagttcaacaatgtaactataaagcgatcatcatccttttttctttatctttttttggttaaaaaaagggagaaaagtaatccaaaaacttttttagaacacattttttttaaaaaaaaattattgctaatatagtaacatgttgaaaccaacacattttattgagaagagctatagaaagatcagcggtcaaaaaaaaaactcgaaatgggtatctcttttactggcaccatattttgtacatttagtatttattcttgatgataataagtaattcagaattgagtttataaaatcttattttgtaatattataaaacatattattctttttatgaccgatacttggagtgaaaaaaattattcgagattaataaatacaatcacttaaaatataatgctatatgaattatgtgcaaatttgtgcaaaagaggcaaaaagattattttccaattataaaaaaaataatacaacttcaacaactggtaactaatattccaagtgagaaaatttaagcagttgcaaaaatcaatccaaaacttgaaaatacaatattaaaaaaaaagtagaatctatttaaagaaaatctattatatcttcactttgccagactttaattttattgttgtcaaactgtgcattgatgaaaatgctaaatgctggagttgtagagaaaatgcgtacgtagagctgactctgtgagggggggaccacgactcgattttcttttttcaaaaaaaaaaaagcagaaaagcccctgtaactatacctaacaaagagtggaaaaataaagaagaaatccatgccggcgcttatagcaataatcactttgactagattttacaaactttttaactgaaaagtctattatatccctgactattataacgaaaaattttcacattagaacaactgggctcagtggcggagctaggaattatacaaaggggtgtcaaaataaaaaaaaattgctactatggggaacggaacttgcaaccttatgcaatttttgacaccccttaaccattgcactaagagtttgtcttgtgtcaaggggtgtcaaccccttgtaaatattcaatttttaagaaaaaatacctaaaatacctatctacacagtgttatttttcggcgaaggggtgtcggttgacacccctcgggcaagggtggctccgccactgactgggctccctactttttaattttatagcccatatttcaatttacaactaactaacccaaaaataataggctaagattcaacatccaactccaataggttctcaaaattactatttaatttttaaaaaagattcctcaagcttttaaattaattttcgaatcagtaattgtgactcaaatattagttcaataaaccaaatccattttgggtggtgaaaattacatttttaacaagtttaaatttcgaatttgattttgtaagaaatttggagtgggtgttatttagacttgttagaaatagtacaaggatgttatatataaaatttaaagtcatttaatggatatttggactggttttgaacaagaattgcaactgaaaatcgtgaaagaagttcgtctacagacgcttgtataaaggtgtataaaagtgtataaggtgtgtttctacactcatatacactattatacataattatacaaaaaaattgacttcgtcttttctgaaatttaactcaaatcttgctcaattctactctaaatcacttcaattttaaattttgaactccttttgatattttcaatcaattggaacaacacccaatccaaacaactaacaaactaaaaaatattcatttttgaaagcaaagctttgaatgatcttcaatggtagacttctactcttaaattttcttacattgcaaccaagtgacacaagaggagaaacagaaaatatatggccccttgaagcatatgtagaagaagtgagaagaagagagagtgaaagcaatggttgtgggaacgggccagcccagcccaagcctcatgggcttttaaatttggtgggctaggacgggccagcccgccatatgaatgagccttaacatgcccagcccttcaattgttttttagaaaaaagaatttctttaaatccttaaatatttttttgtgatatagtcgattaatcatgtaaacaatttctgtttgcttcgatcgtataaaaagcttgatatttgacgaggaatctcgtaagtaaaatgtgaattctctatatctctagctcttcttttttaaagctacataaatattttcttaatacttttctttcattttcctcagaagggtttgctttaataagcttatatgctgaggttctttaatttaggattagtattatttgttgatttcgtcattatattctataaatttttataatttttgaaatttgcaagtggccaaatttttttttgtgtgtgtatttaaaattgatctttttctatactgaatattagtttaaatattaaagtaatccaaactgatcattgtccacttaaagtaatattttcttttgaaaaaaggttattattggccatctaaaacttttcgagttcattattacttaacgaaaagaaaaaataattttgtcatattacatgcatgtcaaaaatataaattctagttgatatggaagggtaaatgagcaatctagtgtaacgacccgaccggtcgttttgagctctagtgcgtcatccagcagtctgggccatgagcagcttcatttcaggtattatgactcgtacgtgtggtcggaattagatttcgggaagttcggagttaatttggaaagagaattctcatttcgaaagcttaaagttgaagaaataaattaggattagaattttgggtaaacaacctcagaatggggatccgaaggttccaacaagttcgcatgatgattttggacttgggcgtatgtccggatcgggttttggatgatccaggagtgttttggcgcctattgtggaagttagcattttggaaggaatttcataagtttggcttggcgtgcatttcagcgttatcgatgtccgtttgggattttgagactgggagtaactccgtacgatgattctagagttgggagcgcgatcagaaatgaattcggaggtccgtgggtcattttgaaagtgtttggccaaagatagaaacttgaaggtttttgagaagtttgaccggaagtggactttttgatatcggggtcggaatccgattccgaaagttgaaataggtccgtaatgtcaaatatgacttgtgtgcaaaatttgaggtcaatcggatatgatttgacgggtttcggcatcgaatgtagaagtttgaaattctaagttcttcaagtttgaaatggagtgctgtaatgacccgacccgtcgtctctcgtacctccgtcctgttatccctgttatatgtttctccgtgtgttgatatgcgtgtttggtaagtttgaagtggtttgggcggaaagtggatggaaatgagacaaatagtctctttaagaaaagcttaattggaaaagtcaacccaacgttgacttatgggttagagggctcggaacggatttccgatggctcgactagtttcgggggttgatttgtgacttagtggcgaaagcggaagtgaattcggagttccggtgtgaaagttagcctattttggcgaagttggattttcggagaaatccggttgataggtgagaatttgatccaagggtcggaatggaattccgaaagttgcattagctccgttaggtgattttggatgtgtctgcaaattttcaggtcattcggaccacgtttgtttggtttcggcatcgaatgtgatattgaaaagtctaagtttaatcttgaattgaattcaaggattttggtgaatttcgatgttaaagatagcgtttttatgatccgagcaagtttgaatgaagtaacaagtcatgttggtgcttttggttgaggtcccgggggcctcggggtgatttcggatggttgtcggacaatttcaaagttgaaaggtgcagcagatttttgagcttcaggtgttgcagacgtttgctctatgcgatcgcaggtctggcattgcgatcgcatagaaggctgggctgggggcttaagttttgttcaatgcgatcgcggcatgggtgatgcgatcgcataggttgagttagtggccctctgcgatcgcagaggtatggacgcggtcgcgtagttctgggcagcggagttatgcgatcgcatggagtagtgtgcgttcgcataggccaagagggggaggcctggaaggttgctctatgtgatcgcaggaggccggtcgcgatcgcatagaggaaggtcgagctgggcagtgtcttttaatgggttatttcatccgcgagcttcattatatttcctccatttttgaagaccttgagagctctttggtgcaaattgaagagggattcgaagaggattgatcggaggtgagttttatgaattcaaaacatcattaaatcatggatttagcccttaaatttctgaaatcaaatcaaattggggaagaactagggcttggaacttcaaatgaagattgaggatttggaggagcaattggactccgattttgatgaacttgatatgtacggactcgtggcgagacgaggattccgaaaatgtaagtttcgtaatttttcgagaagcgagcccgaggctcgggttttgctagtttcgagattttggctatttatcggttgttttcgattgggtattgtcccatttgcctattgtgatgtattcgctctttttttgcttagattcgacgtgcgaggaggccgatttgagaggcaaaggcgtcgcgggcttgagatttcgccggttcgaggtgagtaatgctagtaaatgtttttatgagggtttgaaaccccggactttcacatcgtaacgctatgttgaggcgtgactcgcactcctggataagtgcggagtcgaatgttgttggggattgtgacttggtccatcccgagtgagattctatagtaaattggcgtatgatacgcgtactgtgattgttattattgggctatatgccgtgtttggggcctagtgccgacctgtgatactcttcgagagtggatattactgtttatcatgattgcatatcattcatatcagtccatggctttttaaagcattggtttcaaaacccagccgtatttcaaatgttcaaactcacatgatatcttttcaaatgtatttcggctgaggatcatgacttataactgcccaagtggcttgtgatatattttctggactgatattggttggctcgggctgcacgccacagcggtgattggaccagtggtaacatggacactgtgtcgtatgagcggtcaggtaacatggactgaccgggttattgattttgccaccacgagatggctgattattgcgcttgggctgtaggagcccctccggagtctgtatacacccccagtgagcgccgtcgacgataaatgatatggttggctcggactgcacgccgcagtgggtactggattgtaccaacatttgcattgcatagcatccctgcatttgcaccttatcttacttattgttcagttgttctgatattgtggttttctgttatttagcttactttgtgcatttactgtgttttcttatcttcggagcttcatttattattattactcactgggtcggagtactcacattactccctgcaccttgtgtgcagatccagggcatgctcaggcggattaggtcctgcagcttttcagacatcaacagttcggagcgttgaggtagctgcacggcgttcgcagccatcgaccctccttccctctatctttatttcctgtttttcctgtgtactttcagttaccaccagatttgtatcagattgagttgttattctagaggctcagacttgtgacacctgttcctatgggatttgctattggtttcagttcattccgctctgtcttttgggatataaatctctttcgtgttgagactattatttctttattgtctttatctgggattattgagattgtggtcgggcttgcctagccttacggccgggcgccatcgcgaccgggtttggggtcgtgacaactagtttggggtcgtgacaactagattgtggtcgggcttgcctagccttacggccgggcgccatcgcgaccgggtttggggtcgtgacaacttggtatcagagcctaggttacttggtctcgcgagtcatgagccggtttagtagagtcttgtggatcggtgcgtagacgtccgtatcatatccacgagaggctacagaactgtaggaaaacacctcacattcttggaattcttatcgtgcgtatttgattcagctggggatataacttttgaaaaattccttcttcacgtttgtatgcgcccgtgagcgcccagtgctatatgtgccttgatggctgatgatttccccgatcgaggggcgagtgatgatttctatgagttgatgttgggccattctggaggacttgaggccgaatctgtgtctatagcttgagcaccaaggtgctgattgcgcgagctagtgttatgagctcatgagttcggtatagtccctaaattgcggtaatggcggctgaatagcttcatgatgattgcgttggtgctgtgtgatgtgcttgtattacttgggagtgtgcgtgtggtggtatgaggccagactcaggaagaccaattgattgcgtgaggtgtatggcggtggatgatgtaccaaaatattatattgaaacaagcaggtgggttagcttctgcggattcttctgaagtggtatgaccattatgtgtatgttagaagatcttaagtgtaataaaaaggtattttccatatgttatgattcgatcaggtgcaacgcgtgttcatgtgtcaattttgataatataatacatgtagtattgagattaatgtggttgatgtacattgtaatgtcttgtcaagttatggacgtgttgttaggatggtttggtgattctctggcaggtggataggctcaattacaaaggaaactctgccgaaattttcggaaaaatttgggacttggtaggaattttgtcgcctaaggagtgggcttaacggtggtgtgaatgaatgcaaaaagttgaagaaaggttggaatttctgatgattcgtgtttccacaagcttatggaagagtgagtttaatctcgccatgatgttatgatggctatagagtatgtgtgttttaatatatatggcttcaagctaagttggggaggttgctgttgattagctgactgtacggttatgtactataattggttccgatttgatgcatgtgtgttaatcagttctagctgcagagagtgagccgagggtggctcgagtgaagcaaaatttggccaaggattatatggtacttcgtgggtgtgagaaaatgagggaatgtcttgagttattgatagagagaatgcttagcgtaaagaaaaggaaagttgttcggttgtatcggaaagagatcatgtcctgtggtgtcagggtgtcgataaggcacgaggggttcgatttgttaagtcaagtaatttgcagtaggcataagagtggatgacttttgagaagggtttcgatgtgttcaagaatctatatgtatcactcgggtgttctaaggttgggcatgcgatctagtcagtgttttcattggaacaggtcaagacttatggtatttttatgttaattgcgagattctaagtatcggtattcgggatgaattggcaactaaatcagagtcgcaggaagttcttggggtaaagtactctggaatgtggtagtcccgagaacgttgagaaagtattcagtggcctaagggtcttagacagtgtgggttggtgttcgggtcttgtttagaagcctgggttgaggcattgtggtgctacggcaagagggtgtatcaagttgaaaaggaaccagatgggaatctaggcaaataagtaacttgttgggggaccgaatcggtatggtaaggataggattggttctcgtggtgtatttggggtaatggtttagcacgggaaatttttgcagcaatgctcttggatgttgacgattatctctgtgtgtcgtaattaaaagggattcagtcatggcggtttagttgtgcagacaggattgggagagttcttgttgatccatacagggttgaagaggtgcattttctatgaatgtgagttggcatgagatgtgtaatgattttccttctaaatgagatcaatgaaagatctagactagttgagtgcgtcgacgtctgcggcgcagaaaggagatgaaaggtcttgtgttatcctaggaggatacggtatatgcggtttgttgtaaaggcctgagatgggcatagtgcaaggtctcagttcagttctgaaaggtatggcaggttggttaagacttaagtgacgagtagcttcaggtagtcaaaaaaaaaaatggtgctgttaattggaagtgatttgacgatggcatatgtttcggaaagagggtaatctcgcaaatgatacatcagtagtgttacggcattttcttatggaagactgcggatatctgagttgtttgatggcacatgggagttttaaaaatatacctcgtgggatagttgggtacttgaggtgtgatttgtatttcgcatggtggaaatttggatcaggtgcagtgattcgcgtgctatggttagttggagactgggaattctccggtgcagtctatgtagcggttatggatcgcgtgtgttgtatcggtgctgtcagcggctattggaaggttggaatccggatggatttttccttgcttaataccttaaattctggatatggtatggggatgtaaagtgattgcctcagtgttggattattcgacccgattgtgctatgagtcatgttgggaaatgccacaggttgcgtggcgaggtgtgtcggactatgttctagctgaatggttgtgttccagagtctagcggatagctgggaagaattgcgttccttaattgggtcttcgaggcgaatgtcagtatagaggtttctatcattgattgcggttccggtattgagggactttccagatgcgtccttgtggccgggcatgtcgccgggcgagactgtgaatttcggtaattatttggtgtcgggcaccatatcgttcggctcgtcaagagttatagtagtgaaagtgaaatcttgtagcttgcaatgcttttatgtatatctttatgcactcagttgcttcgaccgatgtggatattttgttattgtgagcaaatttggctcgatgtgcacctccctgtgtgaggtggttgtgtagatcgggtggcactccgccacgggtatgttatctggatcgggttgcgcgccgcaacagtgtgatgttgagaacagttttccatgtggtgatgtgtattctttgcttcctggcttccgagggaagtccgtattgaaaattgctggcgaatagcatttcggttgtgtcctttcaggacggaatggtgtatattacttgtttcaccgtgagagtgatgggttacttgattttaggcattgatatgtgcatggttgtcggctttgagcatggtagcacgaggtgtttcatgtgtatcagtgttgggataggatcgcgcgctgtggcaaggccacgtgaagttatgacctctcgaggaggattcagatactttatttctatgatatgggacggggtccctgctttgttttgtgaaggtatcgatgagtttgaggtataactcttccggttgtgtcattcgcccgatttgggtatgtgtagactgtttcctttggcgcatgtattatgcaaattgtggcttaggcttgtatcgaggcatcatatcaccagcagtggtgtgtcagattcaaggtgatcattgggttattatgaaagtgagcggatttgatttcagctggttaggaggataatatcgtggtttgacccgaaaatccgttgtggtaatagtcaacttggaagtgacttcatgaatggttgatctaaagaactgctacagttcattgcgtgttttagttatcatcggtagtatatgatagtgttggaataaggctttagctaaataagaggttttcctactgggaattgagtattgtgggcaattgccgtgaatagagactattcgttccgagtgttgagatgtgtggtatattgtacgaatttatctaaggttgcaggtgtgggttgttacagctggttcgggctaattccgagtatggatgtgagattctgatcttgtgtatgatttcggaatatgcaatgtgattctgcagtttatgggccagatggattgtgaaatttcggctgtgttttgttatcggcgcctatgtgagttagggtgacgtgggatcaccccgggcacatgtctggtaatgtcatttgattattgggttgcttctagtacatctctggtacgcttgaggacgagcgtttgtttaagttggggaggatgtaatgacccgacccgtcgtctctcgtacctccggcccgttatccctgttatatgtttccccgtgtgttgatatgcgtgtttggtaagttttaagtggtttgggcggcaattggatggaaatgagacaaatagtctctttaagaaaagcttaagttggaaaagtcaacccaacgttgacttatgggttagagggctcggaacggatttccgatggctcgactagtttcgggggttgatttgtgacttagtggcgaaagcggaagtgaattcggagttccggtgtgaaagttagcctattttggcgaagttggattttcggagaaatccggttgataggtgagaatttgatccaagggtcggaatggaattccgaaagttgcattagctccgttaggtgattttggatgtgtctgcaaattttcaggtcattcggacctcgtttggttggtttcggcatcggatgtgatattgaaaagtctaagtttaatcttgaattgaattcaaggattttggtgaatttcgatgttaaagatagcgtttttatgatccgagaaagtttgaatgaagtaacaagtcatgttggtgcttttggttgaggtcccgggggcctcggggtgatttcggatggttgtcggacaatttcaaagttgaaaggtgcagcagatttttgagcttcaggtgttgcagacgtttgctctatgcgatcgcaggtctggcattgcgatcgcatagaacgctgggctgggggcttaagttttgttcaatgcgatcgcggcatgggtgatgcgatcgcataggttgagttagtggccctctgcgatcgcagaggtatggacgcggtcgcgtagttctgggcagcggagttatgcgatcgcatggagtagtgtgcgttcgcataggccaagagggggaggcctggaaggttgctctatgcgatcgcaggaggccggtcgcgatcgcatagaggaaggtcgagctgggcagtgtcttttaatgggttatttcatccgcgagcttcattatatttcctccatttttgaagaccttgagagctctttggtgcaaattgaagagggattcgaagaggattgatcggaggtgagttttatgaattcaaaacatcatttaatcatggatttagcccttaaatttctgaaatcaaatcaaattggggaagaactagggcttggaacttcaaatgaagattgaggatttggaggagcaattggactccgattttgatgaacttgatatgtacggactcgtggcgagatgaggattccgaaaatgtaagtttcgtaatttttcgagaagcgggcccggggctcgggttttgctagtttcgagattttggctatttatcggttgttttcgattggctattgtcccatttgcctattgtgatgtattcgctctgtttttgcttagattcgacgcgcgagaaggccgatttgagaggcaaaggcgtcgcgggcttgagatttcgccggttcgaggtgagtaatgctagtaaatgttgttctgagggtttgaaaccctggactttcacatcgtaacgctatgttgaggcgtgactcgcactcctggataagtgcggagtcggatgttgttggggattgtgacttggtccatcccgagtgagattctatagtaaattggcgtatgatacgcgtactgtgatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

(The sequence listing continues in the following parts.)

The invention claimed is:

1. A non-naturally occurring tobacco plant or germplasm with resistance to tobacco spotted wilt disease (TSWD) and without linkage drag, which is obtained by hybridization using tobacco variety 'Polalta' as TSWD resistance donor parent and a TSWD susceptible tobacco variety as recipient parent and recurrent parent, wherein said non-naturally occurring tobacco plant or germplasm comprises NaChr3_59M marker as set forth in SEQ ID NO: 5, and wherein said non-naturally occurring tobacco plant or germplasm does not comprise NaChr3_44.2M marker as set forth in SEQ ID NO: 1, NaChr3_54M marker as set forth in SEQ ID NO: 2, NaChr3_57M marker as set forth in SEQ ID NO: 3, NaChr3 58M marker as set forth in SEQ ID NO: 4, NaChr3_64.6M marker as set forth in SEQ ID NO: 8, NaChr4_2M marker as set forth in SEQ ID NO: 10 and NaChr4 8M marker as set forth in SEQ ID NO: 11.

2. The non-naturally occurring tobacco plant or germplasm according to claim 1, wherein the non-naturally occurring tobacco plant or germplasm further does not comprise NaChr3_62.6M marker as set forth in SEQ ID NO: 7.

3. The non-naturally occurring tobacco plant or germplasm according to claim 1, wherein the non-naturally occurring tobacco plant or germplasm is selected from the group consisting of Burley tobacco, Dark tobacco, Flue-cured tobacco, Maryland tobacco, Oriental tobacco and Cigar tobacco.

4. A method for screening a tobacco plant or germplasm with resistance to tobacco spotted wilt disease (TSWD) and without linkage drag, the method comprising:
(a) isolating nucleic acids from tobacco plants or germplasms that are obtained by hybridization using tobacco variety 'Polalta' as TSWD resistance donor parent and a TSWD susceptible tobacco variety as recipient parent and recurrent parent;
(b) detecting a TSWD resistance marker, a first linkage drag locus marker and a second linkage drag locus marker in the isolated nucleic acids, wherein the TSWD resistance marker comprises NaChr3_59M marker as set forth in SEQ ID NO: 5, wherein the first linkage drag locus marker comprises NaChr4_2M marker as set forth in SEQ ID NO: 10 and NaChr4_8M marker as set forth in SEQ ID NO: 11, wherein the second linkage drag locus marker comprises NaChr3_44.2M marker as set forth in SEQ ID NO: 1, NaChr3_54M marker as set forth in SEQ ID NO: 2, NaChr3_ 57M marker as set forth in SEQ ID NO: 3, NaChr3_58M marker as set forth in SEQ ID NO: 4, and NaChr3_64.6M marker as set forth in SEQ ID NO: 8; and
(c) selecting a tobacco plant or germplasm that comprises the TSWD resistance marker and does not comprise the first linkage drag locus marker and the second linkage drag locus marker, and wherein said selected a tobacco plant or germplasm is non-naturally occurring.

5. The method according to claim 4, wherein the second linkage drag locus marker further comprises NaChr3_62.6M marker as set forth in SEQ ID NO: 7.

6. The method according to claim 4, wherein the detection includes polymerase chain reaction er and nucleic acid sequencing.

7. A method for breeding a tobacco plant or germplasm with resistance to tobacco spotted wilt disease (TSWD) and without linkage drag, the method comprising:
(a) crossing a first tobacco plant or germplasm thereof with a second tobacco plant or germplasm thereof to produce a progeny tobacco plant or germplasm thereof, wherein the first tobacco plant or germplasm thereof comprises a TSWD resistance marker and does not comprise a first linkage drag locus marker and a second linkage drag locus marker wherein the TSWD resistance marker comprises NaChr3_59M marker as set forth in SEQ ID NO:. 5, wherein the first linkage drag locus marker comprises NaChr4_2M marker as set forth in SEQ ID NO: 10 and NaChr4_8M marker as set forth in SEQ ID NO: 11, wherein the second linkage drag locus marker comprises NaChr3_44.2M marker as set forth in SEQ ID NO: 1, NaChr3_54M marker as set forth in SEQ ID NO: 2, NaChr3_57M marker as set forth in SEQ ID NO: 3, NaChr3 58M marker as set forth in SEQ ID NO: 4, and NaChr3_64.6M marker as set forth in SEQ ID NO: 8, and wherein the first tobacco plant or germplasm thereof is obtained by hybridization using tobacco variety 'Polalta' as TSWD resistance donor parent and a TSWD susceptible tobacco variety as recipient parent and recurrent parent;
(b) isolating nucleic acids from the progeny tobacco plant or germplasm thereof; and
(c) detecting the TSWD resistance marker, the first linkage drag locus marker, and the second linkage drag locus marker in the isolated nucleic acids, thereby producing a progeny tobacco plant or germplasm that comprises the TSWD resistance marker and does not comprise the first linkage drag locus marker and the second linkage drag locus marker, and wherein said produced progeny tobacco plant or germplasm of step (c) is non-naturally occurring.

8. The method according to claim 7, wherein the second linkage drag locus marker further comprises NaChr3_62.6M marker as set forth in SEQ ID NO: 7.

9. The method according to claim 7, wherein the detection includes polymerase chain reaction and nucleic acid sequencing.

10. The method according to claim 7, wherein the first tobacco plant or germplasm thereof and the second tobacco plant or germplasm thereof are selected from the group consisting of Burley tobacco, Dark tobacco, Flue-cured tobacco, Maryland tobacco, Oriental tobacco and Cigar tobacco.

* * * * *